US011096988B2

(12) United States Patent
Swanson et al.

(10) Patent No.: US 11,096,988 B2
(45) **Date of Patent: *Aug. 24, 2021**

(54) CD80 VARIANT IMMUNOMODULATORY PROTEINS AND USES THEREOF

(71) Applicant: Alpine Immune Sciences, Inc., Seattle, WA (US)

(72) Inventors: Ryan Swanson, Seattle, WA (US); Michael Kornacker, Seattle, WA (US); Mark F. Maurer, Seattle, WA (US); Joseph L. Kuijper, Kenmore, WA (US)

(73) Assignee: Alpine Immune Sciences, Inc., Seattle, WA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/161,593

(22) Filed: Jan. 28, 2021

(65) Prior Publication Data

US 2021/0155669 A1 May 27, 2021

Related U.S. Application Data

(63) Continuation of application No. 16/493,750, filed as application No. PCT/US2018/022270 on Mar. 13, 2018.

(60) Provisional application No. 62/582,266, filed on Nov. 6, 2017, provisional application No. 62/574,165, filed on Oct. 18, 2017, provisional application No. 62/537,939, filed on Jul. 27, 2017, provisional application No. 62/475,204, filed on Mar. 22, 2017, provisional application No. 62/472,573, filed on Mar. 17, 2017, provisional application No. 62/472,554, filed on Mar. 16, 2017, provisional application No. 62/472,558, filed on Mar. 16, 2017, provisional application No. 62/472,569, filed on Mar. 16, 2017, provisional application No. 62/472,572, filed on Mar. 16, 2017.

(51) Int. Cl.

| | |
|---|---|
| ***A61P 35/00*** | (2006.01) |
| ***A61K 38/17*** | (2006.01) |
| ***C07K 14/705*** | (2006.01) |
| *A61K 39/00* | (2006.01) |
| *A61K 38/00* | (2006.01) |

(52) U.S. Cl.

CPC .......... *A61K 38/1774* (2013.01); *A61P 35/00* (2018.01); *C07K 14/70532* (2013.01); *A61K 38/00* (2013.01); *A61K 2039/585* (2013.01); *C07K 2319/30* (2013.01)

(58) Field of Classification Search

CPC .................................................. A61K 38/1774
USPC ....................................................... 424/192.1
See application file for complete search history.

(56) References Cited

U.S. PATENT DOCUMENTS

| | | | |
|---|---|---|---|
| 5,168,062 | A | 12/1992 | Stinski |
| 5,208,020 | A | 5/1993 | Chari et al. |
| 5,385,839 | A | 1/1995 | Stinski |
| 5,443,964 | A | 8/1995 | Pickup et al. |
| 5,500,362 | A | 3/1996 | Robinson et al. |
| 5,624,821 | A | 4/1997 | Winter et al. |
| 5,648,260 | A | 7/1997 | Winter et al. |
| 5,698,530 | A | 12/1997 | Schlom et al. |
| 5,716,613 | A | 2/1998 | Guber et al. |
| 5,716,826 | A | 2/1998 | Guber et al. |
| 5,731,168 | A | 3/1998 | Carter et al. |
| 5,767,071 | A | 6/1998 | Palladino et al. |
| 5,780,426 | A | 7/1998 | Palladino et al. |
| 5,821,337 | A | 10/1998 | Carter et al. |
| 5,851,529 | A | 12/1998 | Guber et al. |
| 5,891,432 | A | 4/1999 | Hoo |
| 5,998,205 | A | 12/1999 | Hallenbeck et al. |
| 6,130,316 | A | 10/2000 | Freeman et al. |
| 6,143,290 | A | 11/2000 | Zhang et al. |
| 6,194,551 | B1 | 2/2001 | Idusogie et al. |
| 6,218,510 | B1 | 4/2001 | Sharpe et al. |
| 6,294,660 | B1 | 9/2001 | Sharpe et al. |
| 6,365,619 | B1 | 4/2002 | Shi |
| 6,428,968 | B1 | 8/2002 | Molnar-Kimber et al. |
| 6,596,535 | B1 | 7/2003 | Carter |
| 6,632,670 | B1 | 10/2003 | Wadsworth et al. |
| 6,635,472 | B1 | 10/2003 | Lauermann |
| 6,641,809 | B1 | 11/2003 | Linsley et al. |
| 6,653,103 | B2 | 11/2003 | Peterson et al. |
| 6,689,871 | B1 | 2/2004 | Wolfe et al. |
| 6,723,316 | B2 | 4/2004 | Laquerre et al. |
| 6,737,056 | B1 | 5/2004 | Presta |
| 6,855,317 | B2 | 2/2005 | Koelle et al. |
| 6,887,471 | B1 | 5/2005 | Linsley et al. |
| 6,897,045 | B2 | 5/2005 | Engelhardt et al. |
| 6,936,257 | B1 | 8/2005 | Bennett |

(Continued)

FOREIGN PATENT DOCUMENTS

| | | |
|---|---|---|
| EP | 0757099 | 2/1997 |
| EP | 1173204 | 1/2002 |
| EP | 1385466 | 2/2004 |
| EP | 1391213 | 2/2004 |
| EP | 1520175 | 4/2005 |

(Continued)

OTHER PUBLICATIONS

Linderholm et al (BioProcess International, 2014, 12(10): 20-27).*

(Continued)

*Primary Examiner* — Sean E Aeder
(74) *Attorney, Agent, or Firm* — Morrison & Foerster LLP

(57) ABSTRACT

Provided herein are variant CD80 polypeptides, immunomodulatory proteins comprising variant CD80 polypeptides, and nucleic acids encoding such proteins. The immunomodulatory proteins provide therapeutic utility for a variety of immunological and oncological conditions. Compositions and methods for making and using such proteins are provided.

19 Claims, 31 Drawing Sheets

Specification includes a Sequence Listing.

(56) References Cited

U.S. PATENT DOCUMENTS

| | | | |
|---|---|---|---|
| 6,998,252 | B1 | 2/2006 | Moss et al. |
| 7,001,765 | B2 | 2/2006 | Maass et al. |
| 7,033,826 | B2 | 4/2006 | Perricaudet et al. |
| 7,094,875 | B2 | 8/2006 | Punnonen et al. |
| 7,125,717 | B2 | 10/2006 | Carter |
| 7,153,510 | B1 | 12/2006 | Rose |
| 7,172,893 | B2 | 2/2007 | Rabinowitz et al. |
| 7,238,526 | B2 | 7/2007 | Wilson et al. |
| 7,241,447 | B1 | 7/2007 | Engelhardt et al. |
| 7,247,615 | B2 | 7/2007 | Schlom et al. |
| 7,332,581 | B2 | 2/2008 | Presta |
| 7,368,116 | B2 | 5/2008 | Schlom et al. |
| 7,371,826 | B2 | 5/2008 | Presta |
| 7,378,087 | B2 | 5/2008 | Jefferies et al. |
| 7,537,924 | B2 | 5/2009 | Coffin |
| 7,550,296 | B2 | 6/2009 | Hermiston et al. |
| 7,588,767 | B2 | 9/2009 | Szalay et al. |
| 7,588,771 | B2 | 9/2009 | Szalay et al. |
| 7,612,170 | B2 | 11/2009 | Punnonen et al. |
| 7,619,078 | B2 | 11/2009 | Sharpe et al. |
| 7,662,398 | B2 | 2/2010 | Szalay et al. |
| 7,662,627 | B2 | 2/2010 | Johnson et al. |
| 7,722,868 | B2 | 5/2010 | Cohen et al. |
| 7,731,952 | B2 | 6/2010 | Mohr et al. |
| 7,731,974 | B2 | 6/2010 | Bell et al. |
| 7,754,221 | B2 | 7/2010 | Szalay et al. |
| 7,811,814 | B2 | 10/2010 | Bohn et al. |
| 7,897,146 | B2 | 3/2011 | Brown et al. |
| 7,906,111 | B2 | 3/2011 | Wilson et al. |
| 7,927,585 | B2 | 4/2011 | Snyder |
| 7,943,374 | B2 | 5/2011 | Hildinger |
| 7,968,340 | B2 | 6/2011 | Hallek et al. |
| 8,007,780 | B2 | 8/2011 | Arbetman et al. |
| 8,202,847 | B2 | 6/2012 | Weiner et al. |
| 8,445,447 | B2 | 5/2013 | Chen |
| 8,911,726 | B2 | 12/2014 | Takahashi et al. |
| 8,956,619 | B2 * | 2/2015 | Ostrand-Rosenberg .................... C07K 14/00 424/184.1 |
| 9,103,831 | B2 | 8/2015 | O'Sullivan et al. |
| 9,453,227 | B2 | 9/2016 | Diamond et al. |
| 9,650,429 | B2 | 5/2017 | Ostrand-Rosenberg |
| 9,834,604 | B2 | 12/2017 | Zhu et al. |
| 2002/0168714 | A1 | 11/2002 | Barbas et al. |
| 2003/0138881 | A1 | 7/2003 | Punnonen et al. |
| 2003/0171551 | A1 | 9/2003 | Rosenblatt et al. |
| 2004/0009604 | A1 | 1/2004 | Zhang et al. |
| 2004/0063094 | A1 | 4/2004 | Coffin et al. |
| 2004/0072283 | A1 | 4/2004 | Seed et al. |
| 2004/0146488 | A1 | 7/2004 | Hu et al. |
| 2005/0014934 | A1 | 1/2005 | Hinton et al. |
| 2005/0220818 | A1 | 10/2005 | Lorence |
| 2005/0260601 | A1 | 11/2005 | Whitt et al. |
| 2006/0024298 | A1 | 2/2006 | Lazar et al. |
| 2006/0039894 | A1 | 2/2006 | Mohr et al. |
| 2007/0098743 | A1 | 5/2007 | Bell et al. |
| 2007/0110720 | A1 | 5/2007 | Brown et al. |
| 2007/0202572 | A1 | 8/2007 | Szalay et al. |
| 2007/0212727 | A1 | 9/2007 | Szalay et al. |
| 2009/0010889 | A1 | 1/2009 | Brown et al. |
| 2009/0053244 | A1 | 2/2009 | Chen et al. |
| 2009/0098529 | A1 | 4/2009 | Chen et al. |
| 2009/0117034 | A1 | 5/2009 | Chen et al. |
| 2009/0136917 | A1 | 5/2009 | Szalay et al. |
| 2009/0155287 | A1 | 6/2009 | Chen et al. |
| 2009/0162288 | A1 | 6/2009 | Chen et al. |
| 2009/0215147 | A1 | 8/2009 | Zhang et al. |
| 2009/0274728 | A1 | 11/2009 | Brown et al. |
| 2009/0285860 | A1 | 11/2009 | Martuza et al. |
| 2010/0062016 | A1 | 3/2010 | Szalay et al. |
| 2010/0092515 | A1 | 4/2010 | Conner et al. |
| 2010/0113567 | A1 | 5/2010 | Barber |
| 2010/0136549 | A1 | 6/2010 | Christiansen et al. |
| 2010/0172877 | A1 | 7/2010 | van den Pol et al. |
| 2010/0178276 | A1 | 7/2010 | Sadelain et al. |
| 2010/0178684 | A1 | 7/2010 | Woo et al. |
| 2010/0196325 | A1 | 8/2010 | Szalay et al. |
| 2010/0233078 | A1 | 9/2010 | Szalay et al. |
| 2010/0261660 | A1 | 10/2010 | Punnonen et al. |
| 2011/0002956 | A1 | 1/2011 | Weiner et al. |
| 2011/0064650 | A1 | 3/2011 | Szalay |
| 2011/0064763 | A1 | 3/2011 | Allen et al. |
| 2011/0158948 | A1 | 6/2011 | Brown et al. |
| 2011/0177032 | A1 | 7/2011 | Martuza |
| 2011/0212530 | A1 | 9/2011 | Baltimore et al. |
| 2011/0293705 | A1 | 12/2011 | Irvine et al. |
| 2013/0017199 | A1 | 1/2013 | Langermann |
| 2013/0149305 | A1 | 6/2013 | Ostrand-Rosenberg |
| 2013/0287748 | A1 | 10/2013 | June et al. |
| 2014/0011370 | A1 | 1/2014 | Camphausen |
| 2014/0050708 | A1 | 2/2014 | Powell et al. |
| 2014/0099309 | A1 | 4/2014 | Powell et al. |
| 2014/0154216 | A1 | 6/2014 | Coffin |
| 2014/0186401 | A1 | 7/2014 | Diamond et al. |
| 2014/0227237 | A1 | 8/2014 | June et al. |
| 2014/0322129 | A1 | 10/2014 | Leong et al. |
| 2014/0348832 | A1 | 11/2014 | Zhu et al. |
| 2015/0232532 | A1 | 8/2015 | Ostrand-Rosenberg |
| 2015/0359909 | A1 | 12/2015 | O'Sullivan et al. |
| 2016/0009805 | A1 | 1/2016 | Kowanetz et al. |
| 2016/0017041 | A1 | 1/2016 | Violette et al. |
| 2016/0339066 | A1 | 11/2016 | Szalay et al. |
| 2016/0376346 | A1 * | 12/2016 | Camphausen ........... C07K 7/08 424/134.1 |
| 2017/0145071 | A1 | 5/2017 | Brennan et al. |
| 2017/0226181 | A1 | 8/2017 | Ostrand-Rosenberg |
| 2017/0285037 | A1 | 10/2017 | Kuangara et al. |
| 2018/0244749 | A1 | 8/2018 | Swanson et al. |
| 2018/0256644 | A1 | 9/2018 | Swanson et al. |
| 2019/0135922 | A1 | 5/2019 | Swanson et al. |
| 2019/0175654 | A1 | 6/2019 | Swanson et al. |
| 2020/0040059 | A1 | 2/2020 | Swanson et al. |

FOREIGN PATENT DOCUMENTS

| | | |
|---|---|---|
| EP | 1606411 | 12/2005 |
| EP | 1870459 | 12/2007 |
| EP | 3020816 | 5/2016 |
| WO | WO-1993/010151 | 5/1993 |
| WO | WO-1994/011026 | 5/1994 |
| WO | WO-1994/029351 | 12/1994 |
| WO | WO-1998/050431 | 11/1998 |
| WO | WO-1999/038955 | 8/1999 |
| WO | WO-1999/051642 | 10/1999 |
| WO | WO-2000/042072 | 7/2000 |
| WO | WO-2001/030843 | 5/2001 |
| WO | WO-2002/000717 | 1/2002 |
| WO | WO-2004/029197 | 4/2004 |
| WO | WO-2004/056312 | 7/2004 |
| WO | WO-2005/063816 | 7/2005 |
| WO | WO-2005/100402 | 10/2005 |
| WO | WO-2006/019447 | 2/2006 |
| WO | WO-2006/029879 | 3/2006 |
| WO | WO-2007/052029 | 5/2007 |
| WO | WO-2008/011636 | 1/2008 |
| WO | WO-2008/092117 | 7/2008 |
| WO | WO-2008/155134 | 12/2008 |
| WO | WO-2009/029342 | 3/2009 |
| WO | WO-2009/067800 | 6/2009 |
| WO | WO-2009/076524 | 6/2009 |
| WO | WO-2010/027423 | 3/2010 |
| WO | WO-2010/027827 | 3/2010 |
| WO | WO-2010/027828 | 3/2010 |
| WO | WO-2011/056983 | 5/2011 |
| WO | WO-2011/066342 | 6/2011 |
| WO | WO-2011/113019 | 9/2011 |
| WO | WO-2011/133886 | 10/2011 |
| WO | WO 2012/079000 | 6/2012 |
| WO | WO-2012/125850 | 9/2012 |
| WO | WO-2012/141984 | 10/2012 |
| WO | WO-2012/149364 | 11/2012 |
| WO | WO-2013/003761 | 1/2013 |
| WO | WO-2013/130683 | 9/2013 |
| WO | WO-2013/149167 | 10/2013 |

(56) References Cited

FOREIGN PATENT DOCUMENTS

| | | |
|---|---|---|
| WO | WO-2013/169338 | 11/2013 |
| WO | WO-2014/089169 | 6/2014 |
| WO | WO-2014/198002 | 12/2014 |
| WO | WO-2014/207063 | 12/2014 |
| WO | WO-2015/107026 | 7/2015 |
| WO | WO-2015/181343 | 12/2015 |
| WO | WO-2016/011083 | 1/2016 |
| WO | WO-2016/022994 | 2/2016 |
| WO | WO-2016/073704 | 5/2016 |
| WO | WO-2016/164428 | 10/2016 |
| WO | WO-2016/168771 | 10/2016 |
| WO | WO-2017/029389 | 2/2017 |
| WO | WO-2017/048878 | 3/2017 |
| WO | WO-2017/055547 | 4/2017 |
| WO | WO-2017/079117 | 5/2017 |
| WO | WO-2017/085307 | 9/2017 |
| WO | WO-2017/151818 | 9/2017 |
| WO | WO-2017/181148 | 10/2017 |
| WO | WO-2017/181152 | 10/2017 |
| WO | WO-2017/201131 | 11/2017 |
| WO | WO-2017/201210 | 11/2017 |
| WO | WO-2018/022945 | 2/2018 |
| WO | WO-2018/022946 | 2/2018 |
| WO | WO-2018/075978 | 4/2018 |
| WO | WO-2018/170021 | 9/2018 |
| WO | WO-2018/170023 | 9/2018 |
| WO | WO-2019/136179 | 7/2019 |
| WO | WO 2019/241758 | 12/2019 |
| WO | WO-2019/241758 | 12/2019 |
| WO | WO 2020/061376 | 3/2020 |

OTHER PUBLICATIONS

Sarmay et al (Mol Immunol, 1992, 29(5): Abstract).*

U.S. Appl. No. 16/321,000, filed Jan. 25, 2019, by Swanson et al.

U.S. Appl. No. 16/959,662, filed Jan. 3, 2019, by Swanson et al.

U.S. Appl. No. 16/493,752, filed Sep. 12, 2019, by Swanson et al.

U.S. Appl. No. 16/493,750, filed Sep. 12, 2019, by Swanson et al.

U.S. Appl. No. 16/493,751, filed Sep. 12, 2019, by Swanson et al.

U.S. Appl. No. 17/252,233, filed Dec. 14, 2020, by Swanson et al.

U.S. Appl. No. 17/161,584, filed Jan. 28, 2021, by Swanson et al.

U.S. Appl. No. 17/161,586, filed Jan. 28, 2021, by Swanson et al.

U.S. Appl. No. 17/163,205, filed Jan. 29, 2021, by Swanson et al.

U.S. Appl. No. 17/161,593, filed Jan. 28, 2021, by Swanson et al.

U.S. Appl. No. 17/163,257, filed Jan. 29, 2021, by Swanson et al.

"Database accession No. A0A2K5E9H6," Retrieved from UNIPROT, https://www.uniprot.org/uniprot/A0A2K5E9H6. Retrieved Sep. 13, 2019.

"Database accession No. BDH56778", Retrieved from GENESEQ, Retrieved on Sep. 13, 2019.

"Database accession No. BDV07959," Retrieved from GENESEQ, Retrieved on Sep. 12, 2019.

"Database accession No. A9UFX3," version 38. Retrieved from UNIPROT, http://www.uniprot.org/uniprot/A9UFX3.txt?. Retrieved on Jan. 18, 2018.

"Database accession No. ADM18706." Retrieved from IBIS, http://ibis/exam/dbfetch.jsp?id=GSP:ADM18706. Retrieved on Oct. 10, 2017.

"Database accession No. ADM18913." Retrieved from IBIS, http://ibis/exam/dbfetch.jsp?id=GSP:ADM18913. Retrieved on Oct. 10, 2017.

"Database accession No. B3TFD9," version 63. Retrieved from UNIPROT, http://www.uniprot.org/uniprot/B3TFD9.txt?version=63. Retrieved on Dec. 10, 2017.

"Database accession No. BCD07227." Retrieved from IBIS, http://ibis/exam/dbfetch.jsp?id=GSP:BCD07227. Retrieved on Oct. 10, 2017.

"Database accession No. BCD07228." Retrieved from IBIS, http://ibis/exam/dbfetch.jsp?id=GSP:BCD07228. Retrieved on Oct. 10, 2017.

"Database accession No. BD020821," Retrieved from GENESEQ, https://www.ebi.ac.uk/ena/data/view/BD020821. Retrieved on May 16, 2018.

"Database accession No. BD020825," Retrieved from GENESFQ. https://www.ebi.ac.uk/ena/data/view/BD020825. Retrieved on May 16, 2018.

"Database accession No. F1PWL4," version 43. Retrieved from UNIPROT, http://www.uniprot.org/uniprot/F1PWL4.txt?version=43. Retrieved on Dec. 10, 2017.

"Database accession No. F7DZ76," version 32. Retrieved from UNIPROT, http://www.uniprot.org/uniprot/F7DZ76. Retrieved on Jun. 6, 2018.

"Database accession No. G1SUI3," version 36. Retrieved from UNIPROT, http://www.uniprot.org/uniprot/G1SUI3.txt. Retrieved on Jun. 6, 2018.

"Database accession No. P32506," version 99. Retrieved from UNIPROT, http://www.uniprot.org/uniprot/P32506.txt?. Retrieved on Jan. 18, 2018.

Baban et al., "Bacteria as vectors for gene therapy of cancer," Bioeng Bugs. (2010) 1(6):385-394.

Behr et al., "Trastuzumab and breast cancer," N Engl J Med.(2001) 345:995-996.

Benson et al., "GenBank," Nucleic Acids Res (2013) 41(Database issue):D36-D42.

Biasini et al., "Swiss-Model: modelling protein tertiary and quaternary structure using evolutionary information," Nucleic Acids Res (2014) 42:W252-258.

Boder et al.. "Optimal screening of surface-displayed polypeptide libraries," Biotechnol Prog. (1998) 14:55-62.

Brandt et al., The B7 family member B7-H6 is a tumor cell ligand for the activating natural killer cell receptor NKp30 in humans. J Exp Med. (2009) 206:1495-1503.

Brown et al., "Structure-based mutagenesis of the human immunodeficiency virus type 1 DNA attachment site: effects on integration and cDNA synthesis," J Virol. (1999) 73(11):9011-9020.

Bruggemann et al., "Comparison of the effector functions of human immunoglobulins using a matched set of chimeric antibodies," J Exp Med. (1987) 166(5):1351-1361.

Buchschacher et al., "Human immunodeficiency virus vectors for inducible expression of foreign genes," J Virol. (1992) 66(5):2731-2739.

Burmeister et al., ICOS controls the pool size of effector-memory and regulatory T cells. J Immunol.(2008) 180:774-82.

Busch et al., "Dimers, leucine zippers and DNA-binding domains," Trends Genet. (1990) 6(2): 36-40.

Butte et al., "Programmed death-1 ligand 1 interacts specifically with the B7-1 costimulatory molecule to inhibit T cell responses," Immunity (2007) 27(1):111-122.

Carter et al., "Cytotoxic T-lymphocyte antigen-4 and programmed death-1 function as negative regulators of lymphocyte activation," Immunol Res (2003) 28:49-59.

Carter et al., "Humanization of an anti-p185HER2 antibody for human cancer therapy," Proc Natl Acad Sci USA (1992) 89:4285-4289.

Chadudhri et al., "PD-L1 Binds to B7-1 Only in Cis on the Same Cell Surface," Cancer Immunol Res (2018) 6(8):921-929.

Chakrabarti et al., "A mutant B7-1/Ig fusion protein that selectively binds to CTLA-4 ameliorates anti-tumor DNA vaccination and counters regulatory T cell activity", Vaccine, Elsevier, Amsterdam, NL, vol. 23, No. 37, Aug. 31, 2005 pp. 4553-4564.

Chang et al., "The discovery of small molecule carbamates as potent dual alpha(4)beta(1)/alpha(4)beta(7) integrin antagonists," Bioorg Med Chem Lett. (2002) Jan. 21;12(2):159-63.

Chao et al., "Isolating and engineering human antibodies using yeast surface display," Nat Protoc. (2006) 1:755-768.

Char et al., "Immunoconjugates containing novel maytansinoids: promising anticancer drugs," Cancer Res. (1992) 52(1):127-131.

Chattopadhyay et al., "Structural basis of inducible costimulator ligand costimulatory function: determination of the cell surface oligomeric state and functional mapping of the receptor binding site of the protein," J Immunol. Sep. 15, 2006;177(6):3920-9.

(56) References Cited

OTHER PUBLICATIONS

Chen et al., "MolProbity: all-atom structure validation for macromolecular crystallography," Acra Crystallogr D Biol Crystallogr (2010) 66(Pt 1):12-21.
Clynes et al., "Fc receptors are required in passive and active immunity to melanoma," Proc Natl Acad Sci U S A. (1998) 95(2):652-656.
Cogswell et al., "An Analytical Comparison of Dako 28-8 PharmDx Assay and an E1L3N Laboratory-Developed Test in the Immunohistochemical Detection of Programmed Death-Ligand 1," Mol Diagn Ther (2017) 21(1): 85-93.
Colby et al., "Engineering antibody affinity by yeast surface display," Methods Enzymol. 2004;388:348-58.
Colcher et al., "Use of monoclonal antibodies as radiopharmaceuticals for the localization of human carcinoma xenografts in athymic mice," Methods Enzymol. (1986); 121: 802-16.
Condomines et al., "Tumor-Targeted Human T Cells Expressing CD28-Based Chimeric Antigen Receptors Circumvent CTLA-4 Inhibition," PLoS One (2015) 10(6):e0130518.
Cornetta et al., "No retroviremia or pathology in long-term follow-up of monkeys exposed to a murine amphotropic retrovirus," Hum Gene Ther. (1991) Fall;2(3):215-9.
Cragg et al., "Antibody specificity controls in vivo effector mechanisms of anti-CD20 reagents," Blood. (2004) 103(7):2738-2743.
Cragg et al., "Complement-mediated lysis by anti-CD20 mAb correlates with segregation into lipid rafts," Blood. (2003) 101(3):1045-1052.
David et al., "Protein iodination with solid state lactoperoxidase," Biochemistry. Feb. 26, 1974;13(5):1014-21.
Davis et al., "Macrophage M1/M2 polarization dynamically adapts to changes in cytokine microenvironments in Cryptococcus neoformans infection," M Bio (2013) 4(3):e00264.
De Filipe et al., "Use of the 2A sequence from foot-and-mouth disease virus in the generation of retroviral vectors for gene therapy," Gene Therapy (1999) 6:198-208.
Deisenhofer et al., "Crystallographic refinement and atomic models of a human Fc fragment and its complex with fragment B of protein A from *Staphylococcus aureus* at 2.9- and 2.8-A resolution," Biochemistry. Apr. 28, 1981;20(9):2361-70.
Derer et al., Complement in antibody-based tumor therapy. Crit Rev Immunol. (2014) 34:199-214.
Dull et al., "A Third-Generation Lentivirus Vector with a Conditional Packaging System," J Virology (1998) 72(11): 8463-8471.
Duncan et al., "The binding site for C1q on IgG," Nature. Apr. 21, 1988;332(6166):738-40.
Ellis et al., "Interactions of CD80 and CD86 with CD28 and CTLA4,"J Immunol (1996) 156:2700-2709.
Emsley et al., "Features and development of Coot," Acta Crystallogr D Biol Crystallogr (2010) 66(Pt 4):486-501.
Engelman et al., "Multiple effects of mutations in human immunodeficiency virus type 1 integrase on viral replication," J Virol. 1995 69(5):2729-2736.
Esensten et al., CD28 costimulation: from mechanism to therapy. Immunity. (2016) 44:973-988.
Evans et al., "Generation of Novel Immuno-Oncology Biologics via Directed Evolution of Variant IgSF Domains," Poster Presentation for Immune Checkpoint Inhibitors, Boston, MA (Mar. 14-16, 2017) 1 page.
Evans et al., "Crystal structure of a soluble CD28-Fab complex," Nat Immunol (2005) 6(3):271-279.
Evans et al., "Novel immunomodulatory proteins generated via directed evolution of variant IgSF domains," Abstract for AAI Immunology 2017, Washington D.C. (May 12-16, 2017) 1 page Published Apr. A852017.
Evans et al., "Novel immunomodulatory proteins generated via directed evolution of variant IgSF domains," Poster for AAI Immunology 2017, Washington D.C. (May 12-16, 2017) 1 page.
Evans et al., "Therapeutic T Cell Activation Using Engineered Variant IgSF Domains," Abstract for Society for Immunotherapy of Cancer, National Harbor, MD, (Nov. 9-13, 2016) 1 page Published Nov. 8, 2016.
Evans et al., "Therapeutic T Cell Activation Using Engineered Variant IgSF Domains," Poster presented at Society for Immunotherapy of Cancer, National Harbor, MD, (Nov. 9-13, 2016) 1 page.
Fargeas et al., "Identification of residues in the V domain of CD80 (B7-1) implicated in functional interaction with CD28 and CTLA4", Journal of Exoerimental Medicine, vol. 182, No. 3. Sep. 1, 1995 pp. 667-675.
Ford et al., "Targeting co-stimulatory pathways: transplantation and autoimmunity," Nat Rev Nephrol. (2014) 10(1):14-24.
Fraker et al., "Protein and cell membrane iodinations with a sparingly soluble chloroamide, 1,3,4,6-tetrachloro-3a,6a-diphrenylglycoluril," Biochem Biophys Res Commun. Feb. 28, 1978;80(4):849-57.
Freeman et al., "Engagement of the PD-1 immunoinhibitory receptor by a novel B7 family member leads to negative regulation of lymphocyte activation," J Exp Med (2000) 192(7):1027-1034.
Garcia-Aragoncillo et al., "Design of virotherapy for effective tumor treatment," Curr Opin Mol Ther. Aug. 2010;12(4):403-11.
Gazzano-Santoro et al., "A non-radioactive complement-dependent cytotoxicity assay for anti-CD20 monoclonal antibody," J Immunol Methods. Mar. 28, 1997;202(2):163-71.
Gentz et al., "Parallel association of Fos and Jun leucine zippers juxtaposes DNA binding domains," Science. Mar. 31, 1989;243(4899):1695-9.
Gherardi et al., "Recombinant poxviruses as mucosal vaccine vectors," J Gen Virol. (2005) 86(Pt 11):2925-2936.
Gill et al., "Calculation of protein extinction coefficients from amino acid sequence data," Anal Biochem (1989) 182(2):319-326.
Gregoire-Gauthier et al., "Use of immunoglobulins in the prevention of GvHD in a xenogeneic NOD/SCID/gammac-mouse model," Bone Marrow Transplant (2012) 47:439-450.
Guerra et al., "Host response to the attenuated poxvirus vector NYVAC: upregulation of apoptotic genes and NF-kappaB-responsive genes in infected HeLa cells,"J Virol. Jan. 2006;80(2):985-98.
Haile et al., "A Soluble Form of CD80 Enhances Antitumor Immunity by Neutralizing Programmed Death Ligand-1and Simultaneously Providing Costimulation," Cancer Immunol Res (2014) 2(7): 610-615.
Halaby et al., "The immunoglobulin superfamily: an insight on its tissular, species, and functional diversity," J Mol Evol (1998) 46:89-400.
Hallden et al., "Oncolytic virotherapy with modified adenoviruses and novel therapeutic targets," Expert Opin Ther Targets. Oct. 2012;16(10):945-58.
Harris et al., "CD80 costimulation is essential for the induction of airway eosinophilia," J Exp Med. Jan. 6, 1997;185(1):177-82.
Hellstrom et al., "Antitumor effects of L6, an IgG2a antibody that reacts with most human carcinomas," Proc Natl Acad Sci U S A. (1986) 83(18):7059-7063.
Hellstrom et al., "Strong antitumor activities of IgG3 antibodies to a human melanoma-associated ganglioside," Proc Natl Acad Sci U S A. (1985) 82(5):1499-1502.
Hezareh et al., "Effector function activities of a panel of mutants of a broadly neutralizing antibody against human immunodeficiency virus type 1," J Virol (2001) 75(24):12161-12168.
Hinman et al., "Preparation and characterization of monoclonal antibody conjugates of the calicheamicins: a novel and potent family of antitumor antibiotics," Cancer Res. (1993) 53(14):3336-3342.
Horn et al., "Soluble CD80 Protein Delays Tumor Growth and Promotes Tumor-Infiltrating Lymphocytes," Cancer Immunol Res. (2018) 6(1): 59-68.
Hu et al., "The M2 phenotype of tumor-associated macrophages in the stroma confers a poor prognosis in pancreatic cancer," Tumour Biol (2016) 37(7):8657-8764.
Hu et al., "Yaba-like disease virus: an alternative replicating poxvirus vector for cancer gene therapy," J Virol. (2001) 75(21):10300-10308.

(56) References Cited

OTHER PUBLICATIONS

Hui et al., "T cell costimulatory receptor CD28 is a primary target for PD-1-mediated inhibition," Science (2017) 355(6332):1428-1433.
Hunter et al., "Preparation of iodine-131 labelled human growth hormone of high specific activity," Nature. May 5, 1962;194:495-6.
Idusogie et al., "Mapping of the C1q binding site on rituxan, a chimeric antibody with a human IgG1 Fc," J Immunol. (2000) 164(8):4178-4184.
Ikemizu et al., "Structure and Dimerization of a Soluble Form of B7-1," Immunity (2000) 12:51-60.
Im et al., "Defining CD8+ T cells that provide the proliferative burst after PD-1 therapy," Nature (2016) 537(7620):417-421.
IMGT Scientific Chart, "Correspondence between the IMGT unique numbering for C-Domain, the IMGT exon numbering, the Eu and Kabat numberings: Human IGHG," Last updated Aug. 6, 2016. Retrieved from http://www.imgt.org/IMGTScientificChart/Numbering/Hu_IGHGnber.html.
International Human Genome Sequencing Consortium, "Initial sequencing and anaylysis of the human genome," Nature (2001) 409:860-921.
Infante et al., "Overview Clinical and Pharmacodynamic (PD) Results of a Phase 1 Trial with AMP-224 (B7-DC Fc) that Binds to the PD-1 Receptor," Journal of Clinical Oncology (2013) 31(15_suppl):3044-3044.
Intlekofer et al., "At the bench: preclinical rationale for CTLA-4 and PD-1 blockade as cancer immunotherapy," J Leukoc biol (2013) 94(1):25-39.
Jenkins et al., "CD28 delivers a costimulatory signal involved in antigen-specific IL-2 production by human T cells," J Immunol. (1991) 147:2461-6.
Jenkins et al., "Mechanisms of resistance to immune checkpoint inhibitors," Br J. Cancer (2018) 118(1):9-16.
Jiang et al., "Signatures of T cell dysfunction and exclusion predict cancer immunotherapy response," Nat Med (2018) 24(10):1550-1558.
Johann et al., "GLVR1, a receptor for gibbon ape leukemia virus, is homologous to a phosphate permease of Neurospora crassa and is expressed at high levels in the brain and thymus," J Virol. (1992) 66(3):1635-1640.
Kabat et al., "Sequences of Proteins of Immunological Interest," Fifth Edition, U.S. Department of Health and Human Services, NIH Publication No. 91-3242 (1991), 83 pages.
Kabsch et al., "XDS" Acta Crystallogr D Biol Crystallogr, 2010. 66(Pt 2): p. 125-132.
Kamphorst et al., "Rescue of exhausted CD8 T cells by PD-1-targeted therapies is CD28-dependent," Science (2017) 355(6332):1423-1427.
Kawalec P, et al., "Comparative effectiveness of abatacept, apremilast, secukinumab and ustekinumab treatment of psoriatic arthritis: a systematic review and network meta-analysis" Rheumatology International (2018) 38:189-201.
Ke et al., "Rapid and efficient site-directed mutagenesis by single-tube 'megaprimer' PCR method," Nucleic Acids Research (1997) 25(16):3371-3372.
Khalil et al., "The future of cancer treatment: immunomodulation, CARs and combination immunotherapy," Nat Rev Clin Oncol. (2016) 13(5):273-90.
Khan et al., "Characterization of the New World monkey homologues of human poliovirus receptor CD155," J Virol. Jul. 2008;82(14):7167-79.
Kirn et al., "Targeted and armed oncolytic poxviruses: a novel multi-mechanistic therapeutic class for cancer," Nat Rev Cancer. Jan. 2009;9(1):64-71.
Koike et al., "A second gene for the African green monkey poliovirus receptor that has no putative N-glycosylation site in the functional N-terminal immunoglobulin-like domain," J Virol. Dec. 1992;66(12):7059-66.
Kojima et al., "Fusion Protein of Mutant B7-DC and Fc Enhances the Antitumor Immune Effect of GM-CSF-secreting Whole-cell Vaccine," J Immunother. (2014) 37(3):147-54.
Kolberg, "Gene-transfer virus contaminant linked to monkey's cancer," J NIH Res. (1992) 4:43-44.
Kremer et al., "Treatment of rheumatoid arthritis by selective inhibition of T-cell activation with fusion protein CTLA4Ig," N Engl J Med (2003) 349(20):1907-1915.
Labrijn et al., "Therapeutic IgG4 antibodies engage in Fab-arm exchange with endogenous human IgG4 in vivo," Nat Biotechnol. Aug. 2009;27(8):767-71.
Larsen et al., "Rational development of LEA29Y (belatacept), a high-affinity variant of CTLA4-Ig with potent immunosuppressive properties," Am J Transplant. Mar. 2005;5(3):443-53.
Lazetic et al., "Chimeric co-stimulatory molecules that selectively act through CD28 or CTLA-4 on human T cells," J Biol Chem (2002)11;277(41):38660-38668.
Leabman et al., "Effects of altered FcγR binding on antibody pharmacokinetics in cynomolgus monkeys," MAbs. (2013) 5(6):896-903.
Lee et al., "Molecular mechanism of PD-1/PD-L1 blockade via anti-PD-L1 antibodies atezolizumab and durvalumab," Sci Rep (2017) 7(1):5532.
Leitner et al., "T cell stimulator cells, an efficient and versatile cellular system to assess the role of costimulatory ligands in the activation of human T cells," J Immunol Methods (2010) 362(1-2):131-141.
Levin et al., "Novel Immunomodulatory Proteins Generated via Directed Evolution of Variant IgSF Domains," Abstract for Keystone Symposia: Immune Regulation in Autoimmunity and Cancer, Whistler, British Columbia, Canada (Mar. 26-30, 2017), 1 page Available to Attendees Feb. 26, 2017.
Levin et al., "Novel Immunomodulatory Proteins Generated via Directed Evolution of Variant IgSF Domains," Poster presentation for Keystone Symposia: Immune Regulation in Autoimmunity and Cancer, Whistler, British Columbia, Canada (Mar. 26-30, 2017), 1 page.
Levin et al., "Tumor-Localizing NKp30/ICOSL vIgD Fusion Proteins Direct Effective Dual CD28/ICOS T cell Costimulation to B7-H6+ Tumor Cells in vitro and Tumors in vivo" Poster 2018 SITC (Nov. 7-11, 2018) Published Nov. 6, 2018.
Levin, S.D., et al., "Novel Immunomodulatory proteins generated via directed evolution of variant IgSF domains." Front Immunol., (2020) 10:3086.
Lewis et al., "Novel immunomodulatory proteins generated via directed evolution of variant IgSF domains," Abstract for Poster Presentation at the Federation of Clinical Immunology Societies Meeting, Chicago IL (Jun. 14, 2017) 2 pages Published after Apr. 7, 2017.
Lewis et al., "Novel immunomodulatory proteins generated via directed evolution of variant IgSF domains," Poster Presentation at the Federation of Clinical Immunology Societies Meeting, Chicago IL (Jun. 14, 2017).
Li et al., "Comparison of anti-CD3 and anti-CD28-coated beads with soluble anti-CD3 for expanding human T cells: differing impact on CD8 T cell phenotype and responsiveness to restimulation," J Transl Med. (2010) 8:104.
Li et al., "Structure of the human activating natural cytotoxicity receptor NKp30 bound to its tumor cell ligand B7-H6," J Exp Med (2011) 208(4): 703-714.
Lin et al., "Specific and dual antagonists of alpha(4)beta(1) and alpha(4)beta(7) integrins," Bioorg Med Chem Lett. Jan. 21, 2002;12(2):133-6.
Lindblad-Toh et al., "A high-resolution map of human evolutionary constraint using 29 mammals," Nature (2011) 478(7370):476-482.
Lindblad-Toh et al., "Genome sequence, comparative analysis and haplotype structure of the domestic dog," Nature. Dec. 8, 2005;438(7069):803-19.
Linsley et al., "Human B7-1 (CD80) and B7-2 (CD86) bind with similar avidities but distinct kinetics to CD28 and CTLA-4 receptors," Immunity. Dec. 1994;1(9):793-801.
Lipson et al., "Antagonists of PD-1 and PD-L1 in Cancer Treatment," *Semin Oncol*. Aug. 2015;42(4):587-600.

(56) References Cited

OTHER PUBLICATIONS

Liu et al., "Crystal structure of cell adhesion molecule nectin-2/CD112 and its binding to immune receptor DNAM-1/CD226," J Immunol. Jun. 1, 2012;188(11):5511-20.
Liu et al., "Eradication of large colon tumor xenografts by targeted delivery of maytansinoids," Proc Natl Acad Sci U S A. (1996) 93(16):8618-8623.
Lode et al., "Targeted therapy with a novel enediyene antibiotic calicheamicin theta(I)1 effectively suppresses growth and dissemination of liver metastases in a syngeneic model of murine neuroblastoma," Cancer Res. (1998) 58(14):2925-2928.
Lundqvist et al., "31st Annual Meeting and Associated Programs of the Society for Immunotherapy of Cancer (SITC 2016): part one," J Immunother Cancer, (2016) 4(Suppl 1):82.
Lundqvist et al., "31st Annual Meeting and Associated Programs of the Society for Immunotherapy of Cancer (SITC 2016): part two," J Immunother Cancer, (2016) 4(Suppl 1):82.
Mandler et al., "Immunoconjugates of geldanamycin and anti-HER2 monoclonal antibodies: antiproliferative activity on human breast carcinoma cell lines," J Natl Cancer Inst. Oct. 4, 2000;92(19):1573-81.
Mandler et al., "Modifications in synthesis strategy improve the yield and efficacy of geldanamycin-herceptin immunoconjugates," Bioconjug Chem. Jul.-Aug. 2002;13(4):786-91.
Mandler et al., "Synthesis and evaluation of antiproliferative activity of a geldanamycin-Herceptin immunoconjugate," Bioorg Med Chem Lett. May 15, 2000;10(10):1025-8.
Mantovani et al., "Tumour-associated macrophages as treatment targets in oncology," Nat Rev Clin Oncol (2017) 14(7):399-416.
Maurer et al., "Novel B7-Family-Based Immuno-Oncology Biologics Derived via Directed Evolution of IgSF Domains," Abstract for Society for Immunotherapy of Cancer's (SITC) 32nd Annual Meeting, National Harbor, MD (Nov. 8-12, 2017, Abs P343, 1 page.
Maurer et al., "Novel B7-Family-Based Immuno-Oncology Biologics Derived via Directed Evolution of IgSF Domains," Poster Presentation made at The Society for Immunotherapy of Cancer (SITC), National Harbor, MD (Nov. 8-12, 2017). 1 page.
Maute et al., "Engineering high-affinity PD-1 variants for optimized immunotherapy and immuno-PET imaging," Proc Natl Acad Sci U S A. (2015) 112(47): E6506-14.
Mayr et al., "Passage history, properties, and applicability of the attenuated vaccinia virus strain MVA," Infection. (1975);3:6-14. (English translation of abstract provided).
McLoughlin et al., "TNFerade, an adenovector carrying the transgene for human tumor necrosis factor alpha, for patients with advanced solid tumors: surgical experience and long-term follow-up," Ann Surg Oncol. ( Oct. 2005;12(10):825-30.
McWilliams et al., "Mutations in the 5' end of the human immunodeficiency virus type 1 polypurine tract affect RNase H cleavage specificity and virus titer," J Virol. (2003) 77(20):11150-11157.
Mease et al., "Efficacy and safety of abatacept, a T-cell modulator, in a randomised, double-blind, placebo-controlled, phase III study in psoriatic arthritis," Ann Rheum Dis. (2017) 76:1550-8.
Merchant et al., "An efficient route to human bispecific IgG," Nat Biotechnol. Jul. 1998;16(7):677-81.
Mercier et al., "A chimeric adenovirus vector encoding reovirus attachment protein sigma1 targets cells expressing junctional adhesion molecule 1," Proc Natl Acad Sci U S A. (2004) 101(16):6188-6193.
Miller et al., "Construction and properties of retrovirus packaging cells based on gibbon ape leukemia virus," J Virol. (1991) 65(5):2220-2224.
Miller et al., "Construction and screening of antigen targeted immune yeast surface display antibody libraries," Curr Protoc Cytom. Jul. 2008;Chapter 4:Unit4.7.
Miller et al., "Gene transfer by retrovirus vectors occurs only in cells that are actively replicating at the time of infection," Mol Cell Biol. (1990) 10(8):4239-4242.
Miller, "Protein-protein recognition and the association of immunoglobulin constant domains," J Mol Biol. Dec. 20, 1990;216(4):965-73.
Milone et al., "Chimeric receptors containing CD137 signal transduction domains mediate enhanced survival of T cells and increased antileukemic efficacy in vivo," Mol Ther. (2009) 17(8):1453-64.
Miyoshi et al. "Development of a self-inactivating lentivirus vector,"J Virol. (1998) 72(10):8150-8157.
Molin et al., "Two novel adenovirus vector systems permitting regulated protein expression in gene transfer experiments," J Virol. (1998) 72(10):8358-8361.
Morton et al., "Differential effects of CTLA-4 substitutions on the binding of human cD80 (B7-1) and CD86 (B7-2)," J Immunol. (1996) 156(3):1047-1054.
Motzer et al., "Nivolumab plus Ipilimumab versus Sunitinib in Advanced Renal-Cell Carcinoma," N Engl J Med (2018) 378(14):1277-1290.
Murshudov et al., "REFMACS for the refinement of macromolecular crystal structures," Acta Crystallogr D Biol Crystallogr, 2011. 67(Pt 4): p. 355-67.
Narumi et al., "Adenovirus vector-mediated perforin expression driven by a glucocorticoid-inducible promoter inhibits tumor growth in vivo," Am J Respir Cell Mol Biol. (1998) 19(6):936-941.
Nightingale et al., "Transient gene expression by nonintegrating lentiviral vectors," Mol Ther. (2006) 13(6):1121-1132.
Nishimori et al., "Identification and characterization of bovine programmed death-ligand 2," Microbiol Immunol. (2014) 58(7):388-97.
Nygren, "Conjugation of horseradish peroxidase to Fab fragments with different homobifunctional and heterobifunctional cross-linking reagents. A comparative study," J Histochem Cytochem. May 1982;30(5):407-12.
Ochoa et al., "Antibody-dependent cell cytotoxicity: immunotherapy strategies enhancing effector NK cells," Immunol Cell Biol. (2017) 95:347-55.
Ott et al., "Combination immunotherapy: a road map," J Immunother Cancer (2017) 5:16.
Pain et al., "Preparation of protein A-peroxidase monoconjugate using a heterobifunctional reagent, and its use in enzyme immunoassays," J Immunol Methods. (1981);40(2):219-30.
Parslow et al., "Antibody-drug conjugates for cancer therapy," Biomedicines. (2016) 4:E32.
Patyar et al., "Bacteria in cancer therapy: a novel experimental strategy," J Biomed Sci. (2010) 17(1):21.
Peach et al., "Both extracellular immunoglobin-like domains of CD80 contain residues critical for binding T cell surface receptors CTLA-4 and CD28," J Biol Chem. (1995) 270(36):21181-7.
Peach et al., "Complementarity determining region 1 (CDR1)- and CDR3-analogous regions in CTLA-4 and CD28 determine the binding to B7-1," J Exp Med (1994) 180(6):2049-2058.
Penix et al., "Two essential regulatory elements in the human interferon gamma promoter confer activation specific expression in T cells,"J Exp Med. (1993) 178(5):1483-1496.
Peper et al., "An impedance-based cytotoxicity assay for real-time and label-free assessment of T-cell-mediated killing of adherent cells,"J Immunol Methods. Mar. 2014;405:192-8.
Pérez De La Lastra et al., "Epitope mapping of 10 monoclonal antibodies against the pig analogue of human membrane cofactor protein (MCP)," Immunology. (1999) 96(4):663-70.
Petkova et al., "Enhanced half-life of genetically engineered human IgG1 antibodies in a humanized FcRn mouse model: potential application in humorally mediated autoimmune disease," Int Immunol. (2006) 18(12):1759-1769.
Pfeifer et al., "Gene therapy: promises and problems," Annu Rev Genomics Hum Genet. (2001);2:177-211.
Philpott et al., "Use of nonintegrating lentiviral vectors for gene therapy," Hum Gene Ther. Jun. 2007;18(6):483-9.
Powell et al., "Sequence and structural determinants required for priming of plus-strand DNA synthesis by the human immunodeficiency virus type 1 polypurine tract," J Virol. (1996) 70(8):5288-5296.
Protein Data Bank, "1I8L, Human B7-1/CTLA-4 CO-Stimulatory Complex," Released on Apr. 4, 2001. Retrieved from https://www.rcsb.org/structure/1I8L.

(56) References Cited

OTHER PUBLICATIONS

Qin et al., "Incorporation of a hinge domain improves the expansion of chimeric antigen receptor T cells," J Hematol Oncol. (2017) 10(1):68.
Ravetch et al., "Fc receptors," Annu Rev Immunol. (1991);9:457-92.
Ribas et al., Cancer immunotherapy using checkpoint blockade. Science (2018) 359:1350-1355.
Ridgway et al., "'Knobs-into-holes' engineering of antibody CH3 domains for heavy chain heterodimerization," Protein Eng. Jul. 1996;9(7):617-21.
Roach et al., "Development of a Companion Diagnostic PD-L1 Immunohistochemistry Assay for Pembrolizumab Therapy in Non-Small-cell Lung Cancer," Appl Immunohistochem Mol Morphol (2016) 24(6): 392-7.
Rosenberg et al., "Use of tumor-infiltrating lymphocytes and interleukin-2 in the immunotherapy of patients with metastatic melanoma. A preliminary report," N Engl J Med. (1988) 319(25):1676-1680.
Rowland et al., "Drug localisation and growth inhibition studies of vindesine-monoclonal anti-CEA conjugates in a human tumour xenograft," Cancer Immunol Immunother. (1986);21(3):183-7.
Rowshanravan et al., "CTLA-4: a moving target in immunotherapy," Blood (2018) 131(1):58-67.
Ruperto et al., Abatacept in children with juvenile idiopathic arthritis: a randomised, double-blind, placebo-controlled withdrawal trial. Lancet. (2008) 372:383-391.
Rennert et al., "The IgV domain of human B7-2 (CD86) is sufficient to co-stimulate T lymphocytes and induce cytokine secretion," International Immunology (1997) 9(6):805-813.
Sadelain, M. et al., "The basic principles of chimeric antigen receptor design." Cancer Discov., Apr. 2013, vol. 3, No. 4, pp. 388-398.
Scarpa et al., "CD80 down-regulation is associated to aberrant DNA methylation in non-inflammatory colon carcinogenesis," BMC Cancer (2016):388.
Scholten et al., "Promiscuous behavior of HPV16E6 specific T cell receptor beta chains hampers functional expression in TCR transgenic T cells, which can be restored in part by genetic modification," Cell Oncol. (2010) 32:43-56.
Schwartz et al., "Structural Basis for Co-Stimulation by the Human CTLA-4/B7-2 Complex," Nature (2001) 410 (6828), 604-608.
Schwartz et al., "Structural mechanisms of costimulation," Nat Immunol (2002) 3(5):427-434.
Sciascia S. et al., "Recent advances in the management of systemic lupus erythematosus" [version 1; referees approved:2] F1000Research 2018, 7(F1000 Faculty Rev):970 Last updated: Jun. 29, 2018.
Seow et al., "Biological gene delivery vehicles: beyond viral vectors," Mol Ther. (2009) 17(5):767-777.
Shields et al., "High resolution mapping of the binding site on human IgG1 for Fc gamma RI, Fc gamma RII, Fc gamma RIII, and FcRn and design of IgG1 variants with improved binding to the Fc gamma R," J Biol Chem. (2001) 276(9):6591-6604.
Sommerfelt et al., "Receptor interference groups of 20 retroviruses plating on human cells," Virology. May 1990;176(1):58-69.
Srinivasan et al., "Immunomodulatory peptides from IgSF proteins: a review," Curr Protein Pept Sci. (2005) 6(2):185-96.
Srivastava et al., "Engineering CAR-T cells: Design Concepts," Trends in Immunology (2015) 36(8):494-502.
Stamper et al., "Crystal structure of the B7-1/CTLA-4 complex that inhibits human immune responses," Nature. (2001) 410(6828):608-611.
Stebbings et al., "After TGN1412: recent developments in cytokine release assays," J Immunotoxicol (2013) 10(1):75-82.
Strohl, "Optimization of Fc-mediated effector functions of monoclonal antibodies," Curr Opin Biotechnol. Dec. 2009;20(6):685-91.
Sutharalingam et al., "Cytokine storm in a phase 1 trial of the anti-CD28 monoclonal antibody TGN1412," N Engl J Med (2006) 355(10):1018-1028.
Tangney et al., "The use of Listeria monocytogenes as a DNA delivery vector for cancer gene therapy," Bioeng Bugs. (2010) 1(4):284-287.
Tareen et al., "Design of a novel integration-deficient lentivector technology that incorporates genetic and posttranslational elements to target human dendritic cells," Mol Ther. (2014) 22(3):575-587.
Tartaglia et al., "Highly attenuated poxvirus vectors," AIDS Res Hum Retroviruses. (1992) 8(8):1445-1447.
Terawaki et al., "Specific and high-affinity binding of tetramerized PD-L1 extracellular domain to PD-1-expressing cells: possible application to enhance T cell function," Int Immunol (2007) 19(7):881-890.
Thompson et al., "cis-acting sequences required for inducible interleukin-2 enhancer function bind a novel Ets-related protein, Elf-1," Mol Cell Biol. (1992) 12(3):1043-1053.
Topalian et al., "Safety, activity, and immune correlates of anti-PD-1 antibody in cancer," N engl J Med (2012) 366:2443-2454.
Trentin F et al., "Effectiveness, Tolerability, and Safety of Belimumab in Patients with Refractory SLE: a Review of Observational Clinical-Practice-Based Studies" Clinical Reviews in Allergy & Immunology (2018) 54:331-343.
Vafa et al., "An engineered Fc variant of an IgG eliminates all immune effector functions via structural perturbations," Methods. (2014) 65(1):114-26.
Vagin et al., "Molecular replacement with MOLREP," Acta Crystallographica Section D (2010) 66(1):22-25.
Van Der Merwe et al.. "CD80 (B7-1) binds both CD28 and CTLA-4 with a low affinity and very fast kinetics," J exp Med (1997) 185:393-403.
Van Pijkeren et al., "A novel Listeria monocytogenes-based DNA delivery system for cancer gene therapy," Hum Gene Ther. Apr. 2010;21(4):405-16.
Vessillier et al., "Cytokine release assays for the prediction of therapeutic mAb safety in first-in man trials—Whole blood cytokine release assays are poorly predictive for TGN1412 cytokine storm," J Immunol Methods (2015) 424:43-52.
Vincenti et al., "Costimulation blockade with belatacept in renal transplantation," N Engl J Med. (2005) 353:770-81.
Vitetta et al., "Redesigning nature's poisons to create anti-tumor reagents," Science. Nov. 20, 1987;238(4830):1098-104.
Wade et al., "Genome sequence, comparative analysis, and population genetics of the domestic horse," Science. Nov. 6, 2009;326(5954):865-867.
Wang et al., "In vitro characterization of the anti-PD-1 antibody nivolumab, BMS-936558, and in vivo toxicology in non-human primates," Cancer Immunol Res. (2014) 2(9):846-856.
Wang et al., "Molecular cloning, characterization and three-dimensional modeling of porcine nectin-2/CD112," Vet Immunol Immunopathol. 2009 132(2-4):257-63.
Wang et al., "Molecular modeling and functional mapping of B7-H1 and B7-DC uncouple costimulatory function from PD-1 interaction," J Exp Med. 2003 197(9):1083-91.
Weber et al., "ICOS maintains the T follicular helper cell phenotype by down-regulating Kruppel-like factor 2," J Exp Med. (2015) 212:217-33.
Wei et al., "Distinct Cellular Mechanisms Underlie Anti-CTLA-4 and Anti-PD-1 Checkpoint Blockade," Cell (2017) 170(6):1120-1133.
Wekerle et al., "Belatacept: from rational design to clinical application," Transplant International (2012) 25:139-150.
Wilson et al., "Formation of infectious hybrid virions with gibbon ape leukemia virus and human T-cell leukemia virus retroviral envelope glycoproteins and the gag and pol proteins of Moloney murine leukemia virus," J Virol. (1989) 63(5):2374-2378.
Winn et al., "Overview of the CCP4 suite and current developments," Acta Crystallogr D Biol Crystallogr (2011) 67(Pt 4):235-242.
Wolchok et al., "Overall Survival with Combined Nivolumab and Ipilimumab in Advanced Melanoma," N Engl J Med (2017) 377(14):1345-1356.
Wolchok et al., Development of ipilimumab: a novel immunotherapeutic approach for the treatment of advanced melanoma. Ann N Y Acad Sci. (2013) 1291:1-13.

(56) References Cited

OTHER PUBLICATIONS

Wu et al., "CTLA-4-B7 Interaction Is Sufficient to Costimulate T Cell Clonal Expansion," J. Exp. Med. (1997) 185(7):1327-1335.
Wu et al., "IL-24 modulates IFN-gamma expression in patients with tuberculosis," Immunol Lett. (2008) 117(1):57-62.
Yao et al., "B7-h2 is a costimulatory ligand for CD28 in human," Immunity. (2011) 34(5):729-40.
Yoshinaga et al., cell co-stimulation through B7RP-1 and ICOS. Nature. (1999) 402:827-832.
Yu et al., "The role of B7-CD28 co-stimulation in tumor rejection," Int Imm (1998) 10(6):791-797.
Zak et al., "Structure of the Complex of Human Programmed Death 1, PD-1, and Its Ligand PD-L1," Structure (2015) 23(12):2341-2348.
Zhang et al., "An NKp30-Based Chimeric Anitgen Receptor Promotes T Cell Effector Functions and Antitumor Efficacy in Vivo," J Immunol (2012) 189:2290-2299.
Zhang et al., "Structural basis of a novel PD-L1 nanobody for immune checkpoint blockade," Cell Discov (2017) 3:17004.
Zhang et al., "Introduction to the Data Analysis of the Roche xCELLigence®System with RTCA Package," Bioconductor. May, 3, 2016, bioconductor.org/packages/devel/bioc/vignettes/RTCA/inst/doc/aboutRTCA.pdf, accessed Sep. 9, 2016, 11 pages.
Zhao et al., "Antigen-Presenting Cell-Intrinsic PD-1 Neutralizes PD-L1 in cis to Attenuate PD-1 Signaling in T Cells," Cell Rep (2018) 24(2):379-390.
Zhao et al., "Structural Design of Engineered Costimulation Determines Tumor Rejection Kinetics and Persistence of CAR T Cells," Cancer Cell (2015) 28(4):415-428.
Zhao et al., "TIGIT overexpression diminishes the function of CD4 T cells and ameliorates the severity of rheumatoid arthritis in mouse models," Exp Cell Res. Jan. 1, 2016;340(1):132-8.
Zufferey et al., "Self-inactivating lentivirus vector for safe and efficient in vivo gene delivery,"J Viral. (1998) 72(12):9873-9880.

* cited by examiner

CD80 VARIANT IMMUNOMODULATORY PROTEINS AND USES THEREOF

CROSS-REFERENCE TO RELATED APPLICATIONS

This application is a continuation of U.S. patent application Ser. No. 16/493,750, filed Sep. 12, 2019, which is a U. S. National Stage of International Application No. PCT/US2018/022270 filed Mar. 13, 2018, which claims priority from U.S. provisional patent application 62/472,558, filed Mar. 16, 2017, U.S. provisional patent application 62/472,569 filed Mar. 16, 2017, U.S. provisional patent application 62/472,554 filed Mar. 16, 2017, U.S. provisional patent application 62/472,572 filed Mar. 16, 2017, U.S. provisional patent application 62/472,573, filed Mar. 17, 2017, U.S. provisional patent application 62/475,204, filed Mar. 22, 2017, U.S. provisional patent application 62/537,939, filed Jul. 27, 2017, U.S. provisional patent application 62/574,165, filed Oct. 18, 2017, and U.S. provisional patent application 62/582,266, filed Nov. 6, 2017, the contents of each of which are incorporated by reference in their entirety.

INCORPORATION BY REFERENCE OF SEQUENCE LISTING

The present application is being filed along with a Sequence Listing in electronic format. The Sequence Listing is provided as a file entitled 761612001604SeqList.txt, created Jan. 27, 2021, which is 4,607,510 bytes in size. The information in the electronic format of the Sequence Listing is incorporated by reference in its entirety.

FIELD

The present disclosure relates to therapeutic compositions for modulating immune response in the treatment of cancer and immunological diseases. In some aspects, the present disclosure relates to particular variants of CD80 that exhibit altered binding, such as binding affinity or selectivity, for a cognate binding partner, such as increased affinity for CTLA-4 and/or PD-L1 and/or decreased affinity for CD28.

BACKGROUND

Modulation of the immune response by intervening in the processes that occur in the immunological synapse (IS) formed by and between antigen-presenting cells (APCs) or target cells and lymphocytes is of increasing medical interest. Mechanistically, cell surface proteins in the IS can involve the coordinated and often simultaneous interaction of multiple protein targets with a single protein to which they bind. IS interactions occur in close association with the junction of two cells, and a single protein in this structure can interact with both a protein on the same cell (cis) as well as a protein on the associated cell (trans), likely at the same time. Although therapeutics are known that can modulate the IS, improved therapeutics are needed. Provided are immunomodulatory proteins, including soluble proteins or transmembrane immunomodulatory proteins capable of being expressed on cells, that meet such needs.

SUMMARY

In some embodiments, provided herein is a variant CD80 polypeptide containing an IgV domain or a specific binding fragment thereof, an IgC domain or a specific binding fragment thereof, or both, wherein the variant CD80 polypeptide contains one or more amino acid modifications, at one or more positions, in an unmodified CD80 or specific binding fragment thereof, corresponding to position(s) 7, 23, 26, 30, 34, 35, 46, 51, 55, 57, 58, 65, 71, 73, 78, 79, 82, and/or 84 with reference to numbering of SEQ ID NO: 2. In some embodiments, the one or more amino acid modifications in the unmodified CD80 or specific binding fragment thereof, correspond(s) to position(s) 26, 35, 46, 57, and/or 71 with reference to numbering of SEQ ID NO: 2. In any of the embodiments, the amino acid modification is an amino acid substitution, insertion or deletion.

In some embodiments, the variant CD80 polypeptide contains one or more amino acid substitutions, at one or more positions, in an unmodified CD80 or specific binding fragment thereof, selected from among E7D, E23D, E23G, A26E, A26P, A26S, A26T, I30F, I30T, I30V, K34E, E35D, E35G, D46E, D46V, P51A, N55D, N55I, T57A, T57I, 158V, L65P, A71D, A71G, R73H, R73S, G78A, T79A, T79I, T79L, T79M, T79P, C82R, V84A, and V84I, where the position(s) of the amino acid modification(s) correspond(s) to the numbering of positions of CD80 set forth in SEQ ID NO: 2.

In some embodiments, the provided variant CD80 polypeptide contains one or more further modifications at one or more positions corresponding to position(s) 7, 12, 13, 15, 16, 18, 20, 22, 23, 24, 25, 26, 27, 30, 31, 33, 34, 35, 36, 38, 41, 42, 43, 44, 46, 47, 48, 51, 54, 55, 57, 58, 61, 62, 65, 67, 68, 69, 70, 71, 72, 73, 74, 76, 77, 78, 79, 81, 82, 83, 84, 85, 86, 87, 88, 90, 91, 92, 93, 94, 95, and/or 97 with reference to numbering of SEQ ID NO: 2. In some embodiments, the further modifications include one or more amino acid substitutions in the CD80 or specific binding fragment thereof, selected from among E7D, T13A, T13R, S15P, S15T, C16R, V20A, V20I, V22D, V22I, V22L, E23D, E23G, E24D, L25S, A26E, A26P, A26S, A26T, Q27H, Q27L, 130F, 130T, 130V, Y31S, Q33E, Q33K, Q33L, Q33R, K34E, E35D, E35G, K36R, T41S, M421, M42V, M43L, M43T, D46E, D46V, M47I, M47L, M47V, N48H, N48D, N48H, N48K, N48R, N48S, N48T, N48Y, P51A, Y53F, K54E, K54N, K54R, N55D, N55I, T57A, T57, 158V, I61F, I61V, T62A, T62N, L65P, I67L, I67V, V68E, V68L, I69F, L70M, L70P, L70Q, A71D, A71G, L72V, R73H, R73S, P74S, D76H, E77A, G78A, T79A, T79I, T79L, T79M, T79P, E81G, E81K, C82R, V84A, V84I, L85E, L85M, L85Q, K86M, Y87C, Y87D, Y87H, E88V, F92S, F92V, R94Q, R94W, E95D, E95V, L97M, and L97Q where the position(s) of the amino acid substitution(s) correspond(s) to the numbering of positions of CD80 set forth in SEQ ID NO: 2.

In some embodiments, the one or more amino acid substitution is selected from among: 130F/L70P, Q27H/T41S/A71D, I30T/L70R, T13R/C16R/L70Q/A71D, T57I, M43I/C82R, V22L/M38V/M47T/A71D/L85M, I30V/T57I/L70P/A71D/A91T, V22I/L70M/A71D, N55D/L70P/E77G, T57A/I69T, N55D/K86M, L72P/T79I, T79P, E35D/M47I/L65P/D90N, L25S/E35D/M47I/D90N, A71D, T13A/I61N/A71D, K34E/T41A/L72V, T41S/A71D/V84A, E35D/A71D, E35D/M47I, K36R/G78A, S44P/A71D, Q27H/M431/A71D/R73S, Q33R/K54N/T57I/167V/A71D, E35D/T57I/L70Q/A71D, M42I/I61V/A71D, P51A/A71D, H18Y/M47I/T57I/A71G, V20I/M47V/T57I/V84I, V20I/M47V/A71D, A71D/L72V/E95K, V22L/E35G/A71D/L72P, E35D/A71D, E35D/I67L/A71D, Q27H/E35G/A71D/L72P/T79I, T13R/M42V/M47I/A71D, E35D, E35D/M47I/L70M, E35D/A71D/L72V, E35D/M43L/L70M, A26P/E35D/M43I/L85Q/E88D, E35D/D46V/L85Q, Q27L/E35D/M47I/T57I/L70Q/E88D, M47V/I69F/A71D/V83I, E35D/T57A/A71D/

L85Q, H18Y/A26T/E35D/A71D/L85Q, E35D/M47L, E23D/M42V/M43I/I58V/L70R, V68M/L70M/A71D/E95K, N55I/T57I/I69F, E35D/M43I/A71D, T41S/T57I/L70R, H18Y/A71D/L72P/E88V, V20I/A71D, E23G/A26S/E35D/T62N/A71D/L72V/L85M, A12T/E24D/E35D/D46V/I61V/L72P/E95V, V22L/E35D/M43L/A71G/D76H, E35G/K54E/A71D/L72P, L70Q/A71D, A26E/E35D/M47L/L85Q, D46E/A71D, Y31H/E35D/T41S/V68L/K93R/R94W, A26E/Q33R/E35D/M47L/L85Q/K86E, A26E/Q33R/E35D/M47L/L85Q, E35D/M47L/L85Q, A26E/Q33L/E35D/M47L/L85Q, A26E/Q33L/E35D/M47L, H18Y/A26E/Q33L/E35D/M47L/L85Q, Q33L/E35D/M47I, H18Y/Q33L/E35D/M47I, Q33L/E35D/D46E/M47I, Q33R/E35D/D46E/M47I, H18Y/E35D/M47L, Q33L/E35D/M47V, Q33L/E35D/M47V/T79A, Q33L/E35D/T41S/M47V, Q33L/E35D/M47I/L85Q, Q33L/E35D/M47I/T62N/L85Q, Q33L/E35D/M47V/L85Q, A26E/E35D/M43T/M47L/L85Q/R94Q, Q33R/E35D/K37E/M47V/L85Q, V22A/E23D/Q33L/E35D/M47V, E24D/Q33L/E35D/M47V/K54R/L85Q, S15P/Q33L/E35D/M47L/L85Q, E7D/E35D/M47I/L97Q, Q33L/E35D/T41S/M43I, E35D/M47I/K54R/L85E, Q33K/E35D/D46V/L85Q, Y31S/E35D/M47L/T79L/E88G, H18L/V22A/E35D/M47L/N48T/L85Q, Q27H/E35D/M47L/L85Q/R94Q/E95K, Q33K/E35D/M47V/K89E/K93R, E35D/M47I/E77A/L85Q/R94W, A26E/E35D/M43I/M47L/L85Q/K86E/R94W, Q27H/Q33L/E35D/M47V/N55D/L85Q/K89N, H18Y/V20A/Q33L/E35D/M47V/Y53F, V22A/E35D/V68E/A71D, Q33L/E35D/M47L/A71G/F92S, V22A/R29H/E35D/D46E/M47I, Q33L/E35D/M43I/L85Q/R94W, H18Y/E35D/V68M/L97Q, Q33L/E35D/M47L/V68M/L85Q/E88D, Q33L/E35D/M43V/M47I/A71G, E35D/M47L/A71G/L97Q, E35D/M47V/A71G/L85M/L97Q, H18Y/Y31H/E35D/M47V/A71G/L85Q, E35D/D46E/M47V/L97Q, E35D/D46V/M47I/A71G/F92V, E35D/M47V/T62A/A71G/V83A/Y87H/L97M, Q33L/E35D/N48K/L85Q/L97Q, E35D/L85Q/K93T/E95V/L97Q, E35D/M47V/N48K/V68M/K89N, Q33L/E35D/M47I/N48D/A71G, R29H/E35D/M43V/M47I/149V, Q27H/E35D/M47I/L85Q/D90G, E35D/M47I/L85Q/D90G, E35D/M47I/T62S/L85Q, A26E/E35D/M47L/A71G, E35D/M47I/Y87Q/K89E, V22A/E35D/M47I/Y87N, H18Y/A26E/E35D/M47L/L85Q/D90G, E35D/M47L/A71G/L85Q, E35D/M47V/A71G/E88D, E35D/A71G, E35D/M47V/A71G, 130V/E35D/M47V/A71G/A91V, I30V/Y31C/E35D/M47V/A71G/L85M, V22D/E35D/M47L/L85Q, H18Y/E35D/N48K, E35D/T41S/M47V/A71G/K89N, E35D/M47V/N48T/L85Q, E35D/D46E/M47V/A71D/D90G, E35D/D46E/M47V/A71D, E35D/T41S/M43I/A71G/D90G, E35D/T41S/M43I/M47V/A71G, E35D/T41S/M43I/M47L/A71G, H18Y/V22A/E35D/M47V/T62S/A71G, H18Y/A26E/E35D/M47L/V68M/A71G/D90G, E35D/K37E/M47V/N48D/L85Q/D90N, Q27H/E35D/D46V/M47L/A71G, V22L/Q27H/E35D/M47I/A71G, E35D/D46V/M47L/V68M/L85Q/E88D, E35D/T41S/M43V/M47I/L70M/A71G, E35D/D46E/M47V/N63D/L85Q, E35D/M47V/T62A/A71D/K93E, E35D/D46E/M47V/V68M/D90G/K93E, E35D/M43I/M47V/K89N, E35D/M47L/A71G/L85M/F92Y, E35D/M42V/M47V/E52D/L85Q, V22D/E35D/M47L/L70M/L97Q, E35D/T41S/M47V/L97Q, E35D/Y53H/A71G/D90G/L97R, E35D/A71D/L72V/R73H/E81K, Q33L/E35D/M43I/Y53F/T62S/L85Q, E35D/M38T/D46E/M47V/N48S, Q33R/E35D/M47V/N48K/L85M/F92L, E35D/M38T/M43V/M47V/N48R/L85Q, T28Y/Q33H/E35D/D46V/M47I/A71G, T13R/H18Y/E35D/V68M/L85M/R94Q, T13R/Q27L/Q33L/E35D/T41S/M47V/N48K/V68M/L85M, T13R/Q33L/E35D/M47L/V68M/L85M, T13R/Q33L/E35D/M47V/T62S/V68M/L85M, T13R/Q33R/E35D/M381/M47L/V68M, T13R/Q33R/E35D/M381/M47L/V68M/L85M, T13R/Q33R/E35D/M381/M47L/V68M/L85M/R94Q, T13R/Q33R/E35D/M381/M47L/V68M/E95V/L97Q, T13R/Q33R/E35D/M47L/V68M, T13R/Q33R/E35D/M47L/V68M/L85M, T13R/E35D/M47L/V68M, S15T/H18Y/E35D/M47V/T62A/N64S/A71G/L85Q/D90N, H18Y/V22A/E35D/T41S/M47V/T62N/A71G/A91G, H18Y/V22D/E35D/M47V/N48K/V68M, H18Y/A26E/E35D/M47L, H18Y/A26E/E35D/M47L/V68M, H18Y/A26E/E35D/M47L/V68M/A71G, H18Y/A26E/E35D/M47L/V68M/D90G, H18Y/A26E/E35D/M47L/A71G, H18Y/A26E/E35D/M47L/A71G/D90G, H18Y/A26E/E35D/M47L/D90G, H18Y/A26E/E35D/V68M, H18Y/A26E/E35D/V68M/A71G, H18Y/A26E/E35D/V68M/A71G/D90G, H18Y/A26E/E35D/V68M/D90G, H18Y/A26E/E35D/A71G, H18Y/A26E/E35D/A71G/D90G, H18Y/A26E/E35D/D90G, H18Y/A26E/M47L/A71G, H18Y/A26E/M47L/A71G/D90G, H18Y/A26E/M47L/V68M, H18Y/A26E/M47L/V68M/A71G, H18Y/A26E/M47L/V68M/A71G/D90G, H18Y/A26E/M47L/V68M/D90G, H18Y/A26E/M47L/D90G, H18Y/A26E/V68M/A71G, H18Y/A26E/V68M/A71G/D90G, H18Y/A26E/V68M/D90G, H18Y/A26E/A71G/D90G, H18Y/E35D, H18Y/E35D/M38I/M47L/V68M/L85M, H18Y/E35D/D46E/M47I/V68M/R94L, H18Y/E35D/M47I/V68M/A71G/R94L, H18Y/E35D/M47I/V68M/Y87N, H18Y/E35D/M47L/Y53F/V68M/A71G, H18Y/E35D/M47L/Y53F/V68M/A71G/K93R/E95V, H18Y/E35D/M47L/V68M, H18Y/E35D/M47L/V68M/A71G, H18Y/E35D/M47L/V68M/A71G/L85M, H18Y/E35D/M47L/V68M/A71G/D90G, H18Y/E35D/M47L/V68M/D90G, H18Y/E35D/M47L/V68M/E95V/L97Q, H18Y/E35D/M47L/A71G, H18Y/E35D/M47L/A71G/A91S, H18Y/E35D/M47L/A71G/D90G, H18Y/E35D/M47L/D90G, H18Y/E35D/M47V/N48K, H18Y/E35D/M47V/V68M/L85M, H18Y/E35D/V68M/A71G, H18Y/E35D/V68M/A71G/D90G, H18Y/E35D/V68M/A71G/R94Q/E95V, H18Y/E35D/V68M/D90G, H18Y/E35D/V68M/L85M/R94Q, H18Y/E35D/V68M/T79M/L85M, H18Y/E35D/A71G/D90G, H18Y/M47L/V68M/A71G, H18Y/M47L/V68M/A71G/D90G, H18Y/M47L/V68M/D90G, H18Y/M47L/A71G/D90G, H18Y/V68M/A71G/D90G, S21P/E35D/K37E/D46E/M47I/V68M, S21P/E35D/K37E/D46E/M47I/V68M/R94L, V22A/E35D/M47L/A71G, V22D/E24D/E35D/M47L/V68M, V22D/E24D/E35D/M47L/V68M/L85M/D90G, V22D/E24D/E35D/M47V/V68M, E24D/Q27R/E35D/T41S/M47V/L85Q, E24D/E35D/M47L/V68M/E95V/L97Q, A26E/Q27R/E35D/M47L/N48Y/L85Q, A26E/E35D/M47L/V68M, A26E/E35D/M47L/V68M/A71G, A26E/E35D/M47L/V68M/A71G/D90G, A26E/E35D/M47L/V68M/D90G, A26E/E35D/M47L/A71G, A26E/E35D/M47L/A71G/D90G, A26E/E35D/M47L/D90G, A26E/E35D/V68M/A71G, A26E/E35D/V68M/A71G/D90G, A26E/E35D/V68M/D90G, A26E/E35D/A71G/D90G, A26E/M47L/V68M/A71G, A26E/M47L/V68M/A71G/D90G, A26E/M47L/V68M/D90G, A26E/M47L/A71G/D90G, A26E/V68M/A71G/D90G, Q27L/Q33L/E35D/T41S/M47V/N48K/V68M/L85M, Q27H/E35D/M47I, Q27L/E35D/M47V/I61V/L85M, R29C/E35D/M47L/V68M/A71G/L85M, Q33L/E35D/M47V/T62S/V68M/L85M, Q33R/E35D/M381/M47L/V68M, Q33R/M47V/T62N/A71G, E35D, E35D/T41S/D46E/M47I/V68M/K93R/E95V, E35D/T41S/N48T, E35D/M43I/D46E/A71G/L85M, E35D/M43I/M47L/V68M, E35D/M43I/M47L/L85M, E35D/D46E, E35D/D46E/M47I, E35D/

D46E/M47I/T62A/V68M/L85M/Y87C, E35D/D46E/M47L/V68M/A71G/Y87C/K93R, E35D/D46E/M47L/V68M/T79M/L85M, E35D/D46E/M47L/V68M/T79M/L85M/L97Q, E35D/D46E/M47L/V68M/L85Q/F92L, E35D/D46E/M47I/V68M/L85M, E35D/D46E/M47V/V68M/L85Q, E35D/D46E/L85M, E35D/D46E/A91G, E35D/D46V, E35D/D46V/M47L, E35D/D46V/M47L/V68M, E35D/D46V/M47L/V68M/L85Q, E35D/D46V/M47L/V68M/E88D, E35D/D46V/M47L/V68M/K89N, E35D/D46V/M47L/V68M/D90G, E35D/D46V/M47L/L70M, E35D/D46V/M47L/L70M/L85Q, E35D/D46V/M47L/L85Q, E35D/D46V/M47V/N48K/V68M, E35D/D46V/M47V/V68M/K89N, E35D/D46V/M47V/V68M/L85Q, E35D/D46V/V68M, E35D/D46V/V68M/L85Q, E35D/D46V/L85Q, E35D/M47I/N48K/I61F, E35D/M47I/T62S/L85Q/E88D, E35D/M47I/V68M/Y87N, E35D/M47L, E35D/M47L/Y53F/V68M/A71G/K93R/E95V, E35D/M47L/V68M, E35D/M47L/V68M/A71G, E35D/M47L/V68M/A71G/D90G, E35D/M47L/V68M/A71G/L85Q/D90G, E35D/M47L/V68M/D90G, E35D/M47L/V68M/E95V/L97Q, E35D/M47L/V68M/L85Q, E35D/M47L/L70M, E35D/M47L/A71G, E35D/M47L/A71G/L85M, E35D/M47L/A71G/D90G, E35D/M47L/L85Q, E35D/M47V, E35D/M47V/N48K, E35D/M47V/N48K/V68M, E35D/M47V/N48K/V68M/A71G/L85M, E35D/M47V/N48K/V68M/L85M, E35D/M47V/N48K/V68M/L85Q, E35D/M47V/N48K/V68M/K89N, E35D/M47V/N48K/L85M, E35D/M47V/N48K/K89N, E35D/M47V/I61V/L85M, E35D/M47V/T62S/L85Q, E35D/M47V/V68M, E35D/M47V/V68M/L85M, E35D/M47V/V68M/L85M/Y87D, E35D/M47V/V68M/L85Q/K89N, E35D/M47V/V68M/K89N, E35D/M47V/L85M/R94Q, E35D/M47V/K89N, E35D/N48K, E35D/N48K/V68M, E35D/N48K/V68M/K89N, E35D/N48K/L72V, E35D/N48K/K89N, E35D/V68M, E35D/V68M/A71G/D90G, E35D/V68M/L85Q, E35D/V68M/K89N, E35D/L85Q, E35D/K89N, E35D/L97R, M43I/M47L/A71G, D46V, D46V/M47I/A71G, D46V/M47L, D46V/M47L/V68M, D46V/M47L/V68M/L85Q, D46V/M47L/L85Q, D46V/V68M, D46V/V68M/L85Q, D46V/L85Q, M47I/A71G, M47L, M47L/V68M, M47L/V68M/A71G/D90G, M47L/V68M/L85Q, M47L/L85Q, M47V, M47V/N48K, M47V/N48K/V68M, M47V/N48K/V68M/K89N, M47V/N48K/K89N, M47V/V68M, M47V/V68M/K89N, M47V/K89N, N48K, N48K/V68M, N48K/V68M/K89N, N48K/K89N, V68M, V68M/L85Q, V68M/K89N, L85Q, K89N, and delE10-A98, where the position(s) of the amino acid substitution(s) correspond(s) to the positions of CD80 set forth in SEQ ID NO: 2.

In some embodiments, provided herein is a variant CD80 polypeptide containing an IgV domain or a specific binding fragment thereof, an IgC domain or a specific binding fragment thereof, or both, wherein the variant CD80 polypeptide contains one or more amino acid substitutions in an unmodified CD80 or specific binding fragment thereof, selected from among E7D, T13A, T13R, S15P, S15T, C16R, V20A, V20I, V22D, V22I, V22L, E23D, E23G, E24D, L25S, A26E, A26P, A26S, A26T, Q27H, Q27L, T28Y, 130F, 130T, 130V, Y31C, Y31S, Q33E, Q33K, Q33L, Q33R, K34E, E35D, E35G, K36R, T41S, M421, M42V, M43L, M43T, D46E, D46V, M47I, M47L, M47V, N48D, N48H, N48K, N48R, N48S, N48T, N48Y, P51A, Y53F, Y53H, K54E, K54N, K54R, N55D, N55I, T57A, T57I, 158V, I61V, T62A, T62N, N63D, L65P, I67L, I67V, V68E, V68L, I69F, L70M, L70P, L70Q, A71D, A71G, L72V, R73H, R73S, P74S, D76H, E77A, G78A, T79A, T79I, T79L, T79M, T79P, E81G, E81K, C82R, V84A, V84I, L85E, L85M, L85Q, K86M, Y87C, Y87D, Y87H, Y87Q, E88V, F92S, F92V, R94Q, R94W, E95D, E95V, L97M, and L97Q, where the position(s) of the amino acid substitution(s) correspond(s) to the numbering of positions of CD80 set forth in SEQ ID NO: 2.

In some embodiments, the provided variant CD80 polypeptide contains one or more further modifications at one or more positions corresponding to position(s) 7, 12, 13, 15, 16, 18, 20, 22, 23, 24, 25, 26, 27, 28, 29, 30, 31, 33, 34, 35, 36, 37, 38, 41, 42, 43, 44, 46, 47, 48, 51, 53, 54, 55, 57, 58, 61, 62, 63, 65, 67, 68, 69, 70, 71, 72, 73, 74, 76, 77, 78, 79, 81, 82, 83, 84, 85, 86, 87, 88, 89, 90, 91, 92, 93, 94, 95, and/or 97 with reference to numbering of SEQ ID NO: 2. In some embodiments, the further modifications include one or more amino acid substitutions in the CD80 or specific binding fragment thereof, selected from among E7D, A12T, A12V, T13A, T13R, S15P, S15T, C16R, H18L, H18Y, V20A, V20I, V22A, V22D, V22I, V22L, E23D, E23G, E24D, L25S, A26E, A26P, A26S, A26T, Q27H, Q27L, T28Y, R29H, I30F, I30T, I30V, Y31C, Y31H, Y31S, Q33E, Q33H, Q33K, Q33L, Q33R, K34E, E35D, E35G, K36R, K37E, M38T, M38V, T41A, T41S, M42I, M42V, M43I, M43L, M43T, M43V, S44P, D46E, D46V, M47I, M47L, M47T, M47V, N48D, N48H, N48K, N48R, N48S, N48T, N48Y, P51A, K54E, Y53F, Y53H, K54R, N55D, N55I, T57A, T57I, 158V, I61F, I61N, I61V, T62A, T62N, T62S, N63D, L65P, I67L, I67T, V68A, V68L, V68M, I69F, I69T, L70M, L70P, L70Q, L70R, A71D, A71G, L72P, L72V, R73S, P74S, D76H, E77GE77A, G78A, T79A, T79I, T79L, T79M, T79P, E81G, E81K, C82R, V83A, V83I, V84A, V84I, L85E, L85M, L85Q, K86E, K86M, Y87C, Y87D, Y87H, Y87N, Y87Q, E88D, E88V, E88G, K89E, K89N, D90G, D90N, A91S, A91T, A91V, F92L, F92S, F92V, F92Y, K93E, K93R, K93T, R94Q, R94W, E95D, E95K, E95V, L97M, L97Q, E95V, and L97R where the position(s) of the amino acid substitution(s) correspond(s) to the numbering of positions of CD80 set forth in SEQ ID NO: 2.

In some embodiments, the one or more amino acid substitution is selected from among: 130F/L70P, Q27H/T41S/A71D, I30T/L70R, T13R/C16R/L70Q/A71D, T57I, M43I/C82R, V22L/M38V/M47T/A71D/L85M, I30V/T57I/L70P/A71D/A91T, V22I/L70M/A71D, N55D/L70P/E77G, T57A/I69T, N55D/K86M, L72P/T79I, L70P/F92S, T79P, E35D/M47I/L65P/D90N, L25S/E35D/M47I/D90N, A71D, E81K/A91S, A12V/M47V/L70M, K34E/T41A/L72V, T41S/A71D/V84A, E35D/A71D, E35D/M47I, K36R/G78A, Q33E/T41A, M47V/N48H, M47L/V68A, S44P/A71D, Q27H/M43I/A71D/R73S, E35D/T57I/L70Q/A71D, M47I/E88D, M42I/I61V/A71D, P51A/A71D, H18Y/M47I/T57I/A71G, V20I/M47V/T57I/V84I, V20I/M47V/A71D, A71D/L72V/E95K, V22L/E35G/A71D/L72P, E35D/A71D, E35D/I67L/A71D, Q27H/E35G/A71D/L72P/T79I, T13R/M42V/M47I/A71D, E35D, E35D/M47I/L70M, E35D/A71D/L72V, E35D/M43L/L70M, A26P/E35D/M43I/L85Q/E88D, E35D/D46V/L85Q, Q27L/E35D/M47I/T57I/L70Q/E88D, M47V/I69F/A71D/V83I, E35D/T57A/A71D/L85Q, H18Y/A26T/E35D/A71D/L85Q, E35D/M47L, E23D/M42V/M43I/I58V/L70R, V68M/L70M/A71D/E95K, N55I/T57I/I69F, E35D/M43I/A71D, T41S/T57I/L70R, H18Y/A71D/L72P/E88V, V20I/A71D, E23G/A26S/E35D/T62N/A71D/L72V/L85M, A12T/E24D/E35D/D46V/I61V/L72P/E95V, V22L/E35D/M43L/A71G/D76H, E35G/K54E/A71D/L72P, L70Q/A71D, A26E/E35D/M47L/L85Q, D46E/A71D, Y31H/E35D/T41S/V68L/K93R/R94W, A26E/Q33R/E35D/M47L/L85Q/K86E, A26E/Q33R/E35D/M47L/L85Q, E35D/M47L/L85Q, A26E/Q33L/E35D/M47L/L85Q, A26E/Q33L/E35D/M47L, H18Y/A26E/

Q33L/E35D/M47L/L85Q, Q33L/E35D/M47I, H18Y/Q33L/E35D/M47I, Q33L/E35D/D46E/M47I, Q33R/E35D/D46E/M47I, H18Y/E35D/M47L, Q33L/E35D/M47V, Q33L/E35D/M47V/T79A, Q33L/E35D/T41S/M47V, Q33L/E35D/M47I/L85Q, Q33L/E35D/M47I/T62N/L85Q, Q33L/E35D/M47V/L85Q, A26E/E35D/M43T/M47L/L85Q/R94Q, Q33R/E35D/K37E/M47V/L85Q, V22A/E23D/Q33L/E35D/M47V, E24D/Q33L/E35D/M47V/K54R/L85Q, S15P/Q33L/E35D/M47L/L85Q, E7D/E35D/M47I/L97Q, Q33L/E35D/T41S/M43I, E35D/M47I/K54R/L85E, Q33K/E35D/D46V/L85Q, Y31S/E35D/M47L/T79L/E88G, H18L/V22A/E35D/M47L/N48T/L85Q, Q27H/E35D/M47L/L85Q/R94Q/E95K, Q33K/E35D/M47V/K89E/K93R, E35D/M47I/E77A/L85Q/R94W, A26E/E35D/M43I/M47L/L85Q/K86E/R94W, Q27H/Q33L/E35D/M47V/N55D/L85Q/K89N, H18Y/V20A/Q33L/E35D/M47V/Y53F, V22A/E35D/V68E/A71D, Q33L/E35D/M47L/A71G/F92S, V22A/R29H/E35D/D46E/M47I, Q33L/E35D/M43I/L85Q/R94W, H18Y/E35D/V68M/L97Q, Q33L/E35D/M47L/V68M/L85Q/E88D, Q33L/E35D/M43V/M47I/A71G, E35D/M47L/A71G/L97Q, E35D/M47V/A71G/L85M/L97Q, H18Y/Y31H/E35D/M47V/A71G/L85Q, E35D/D46E/M47V/L97Q, E35D/D46V/M47I/A71G/F92V, E35D/M47V/T62A/A71G/V83A/Y87H/L97M, Q33L/E35D/N48K/L85Q/L97Q, E35D/L85Q/K93T/E95V/L97Q, E35D/M47V/N48K/V68M/K89N, Q33L/E35D/M47I/N48D/A71G, R29H/E35D/M43V/M47I/I49V, Q27H/E35D/M47I/L85Q/D90G, E35D/M47I/L85Q/D90G, E35D/M47I/T62S/L85Q, A26E/E35D/M47L/A71G, E35D/M47I/Y87Q/K89E, V22A/E35D/M47I/Y87N, H18Y/A26E/E35D/M47L/L85Q/D90G, E35D/M47L/A71G/L85Q, E35D/M47V/A71G/E88D, E35D/A71G, E35D/M47V/A71G, I30V/E35D/M47V/A71G/A91V, 130V/Y31C/E35D/M47V/A71G/L85M, V22D/E35D/M47L/L85Q, H18Y/E35D/N48K, E35D/T41S/M47V/A71G/K89N, E35D/M47V/N48T/L85Q, E35D/D46E/M47V/A71D/D90G, E35D/D46E/M47V/A71D, E35D/T41S/M43I/A71G/D90G, E35D/T41S/M43I/M47V/A71G, E35D/T41S/M43I/M47L/A71G, H18Y/V22A/E35D/M47V/T62S/A71G, H18Y/A26E/E35D/M47L/V68M/A71G/D90G, E35D/K37E/M47V/N48D/L85Q/D90N, Q27H/E35D/D46V/M47L/A71G, V22L/Q27H/E35D/M47I/A71G, E35D/D46V/M47L/V68M/L85Q/E88D, E35D/T41S/M43V/M47I/L70M/A71G, E35D/D46E/M47V/N63D/L85Q, E35D/M47V/T62A/A71D/K93E, E35D/D46E/M47V/V68M/D90G/K93E, E35D/M43I/M47V/K89N, E35D/M47L/A71G/L85M/F92Y, E35D/M42V/M47V/E52D/L85Q, V22D/E35D/M47L/L70M/L97Q, E35D/T41S/M47V/L97Q, E35D/Y53H/A71G/D90G/L97R, E35D/A71D/L72V/R73H/E81K, Q33L/E35D/M43I/Y53F/T62S/L85Q, E35D/M38T/D46E/M47V/N48S, Q33R/E35D/M47V/N48K/L85M/F92L, E35D/M38T/M43V/M47V/N48R/L85Q, T28Y/Q33H/E35D/D46V/M47I/A71G, E35D/N48K/L72V, E35D/T41S/N48T, D46V/M47I/A71G, M47I/A71G, E35D/M43I/M47L/L85M, E35D/M43I/D46E/A71G/L85M, H18Y/E35D/M47L/A71G/A91S, E35D/M47I/N48K/I61F, E35D/M47V/T62S/L85Q, M43I/M47L/A71G, E35D/M47V, E35D/M47L/A71G/L85M, V22A/E35D/M47L/A71G, E35D/M47L/A71G, E35D/D46E/M47I, Q27H/E35D/M47I, E35D/D46E/L85M, E35D/D46E/A91G, E35D/D46E, E35D/L97R, H18Y/E35D, Q27L/E35D/M47V/I61V/L85M, E35D/M47V/I61V/L85M, E35D/M47V/L85M/R94Q, E35D/M47V/N48K/L85M, H18Y/E35D/M47V/N48K, A26E/Q27R/E35D/M47L/N48Y/L85Q, E35D/D46E/M47L/V68M/L85Q/F92L, E35D/M47I/T62S/L85Q/E88D, E24D/Q27R/E35D/T41S/M47V/L85Q, S15T/H18Y/E35D/M47V/T62A/N64S/A71G/L85Q/D90N, E35D/M47L/V68M/A71G/L85Q/D90G, H18Y/E35D/M47I/V68M/A71G/R94L, Q33R/M47V/T62N/A71G, H18Y/V22A/E35D/T41S/M47V/T62N/A71G/A91G, E35D/M47L/L70M, E35D/M47L/V68M, E35D/D46V/M47L/V68M/E88D, E35D/D46V/M47L/V68M/D90G, E35D/D46V/M47L/V68M/K89N, E35D/D46V/M47L/V68M/L85Q, E35D/D46V/M47L/V68M, E35D/D46V/M47L/V70M, E35D/D46V/M47L/V70M/L85Q, E35D/M47V/N48K/V68M, E24D/E35D/M47L/V68M/E95V/L97Q, E35D/D46E/M47I/T62A/V68M/L85M/Y87C, E35D/D46E/M47I/V68M/L85M, E35D/D46E/M47L/V68M/A71G/Y87C/K93R, E35D/D46E/M47L/V68M/T79M/L85M, E35D/D46E/M47L/V68M/T79M/L85M/L97Q, E35D/D46E/M47V/V68M/L85Q, E35D/M43I/M47L/V68M, E35D/M47I/V68M/Y87N, E35D/M47L/V68M/E95V/L97Q, E35D/M47L/Y53F/V68M/A71G/K93R/E95V, E35D/M47V/N48K/V68M/A71G/L85M, E35D/M47V/N48K/V68M/L85M, E35D/M47V/V68M/L85M, E35D/M47V/V68M/L85M/Y87D, E35D/T41S/D46E/M47I/V68M/K93R/E95V, H18Y/E35D/D46E/M47I/V68M/R94L, H18Y/E35D/M38I/M47L/V68M/L85M, H18Y/E35D/M47I/V68M/Y87N, H18Y/E35D/M47L/V68M/A71G/L85M, H18Y/E35D/M47L/V68M/E95V/L97Q, H18Y/E35D/M47L/Y53F/V68M/A71G, H18Y/E35D/M47L/Y53F/V68M/A71G/K93R/E95V, H18Y/E35D/M47V/V68M/L85M, H18Y/E35D/V68M/A71G/R94Q/E95V, H18Y/E35D/V68M/L85M/R94Q, H18Y/E35D/V68M/T79M/L85M, H18Y/V22D/E35D/M47V/N48K/V68M, Q27L/Q33L/E35D/T41S/M47V/N48K/V68M/L85M, Q33L/E35D/M47V/T62S/V68M/L85M, Q33R/E35D/M38I/M47L/V68M, R29C/E35D/M47L/V68M/A71G/L85M, S21P/E35D/K37E/D46E/M47I/V68M, S21P/E35D/K37E/D46E/M47I/V68M/R94L, T13R/E35D/M47L/V68M, T13R/H18Y/E35D/V68M/L85M/R94Q, T13R/Q27L/Q33L/E35D/T41S/M47V/N48K/V68M/L85M, T13R/Q33L/E35D/M47L/V68M/L85M, T13R/Q33L/E35D/M47V/T62S/V68M/L85M, T13R/Q33R/E35D/M38I/M47L/V68M, T13R/Q33R/E35D/M381/M47L/V68M/E95V/L97Q, T13R/Q33R/E35D/M381/M47L/V68M/L85M, T13R/Q33R/E35D/M381/M47L/V68M/L85M/R94Q, T13R/Q33R/E35D/M47L/V68M, T13R/Q33R/E35D/M47L/V68M/L85M, V22D/E24D/E35D/M47L/V68M, V22D/E24D/E35D/M47L/V68M/L85M/D90G, V22D/E24D/E35D/M47V/V68M, E35D/D46V, E35D/V68M, E35D/L85Q, D46V/M47L, D46V/V68M, D46V/L85Q, M47L/V68M, M47L/L85Q, V68M/L85Q, E35D/D46V/M47L, E35D/D46V/V68M, E35D/D46V/L85Q, E35D/V68M/L85Q, D46V/M47L/V68M, D46V/M47L/L85Q, D46V/V68M/L85Q, M47L/V68M/L85Q, E35D/D46V/M47L/L85Q, E35D/D46V/V68M/L85Q, E35D/M47L/V68M/L85Q, D46V/M47L/V68M/L85Q, E35D/N48K, E35D/K89N, M47V/N48K, M47V/V68M, M47V/K89N, N48K/V68M, N48K/K89N, E35D/M47V/N48K, E35D/M47V/V68M, E35D/M47V/K89N, E35D/N48K/V68M, E35D/N48K/K89N, E35D/V68M/K89N, M47V/N48K/V68M, M47V/N48K/K89N, M47V/V68M/K89N, N48K/V68M/K89N, E35D/M47V/N48K/K89N, E35D/M47V/V68M/K89N, E35D/N48K/V68M/K89N, M47V/N48K/V68M/K89N, E35D/D46V/M47V/N48K/V68M, E35D/D46V/M47V/V68M/L85Q, E35D/D46V/M47V/V68M/K89N, E35D/M47V/N48K/V68M/L85Q, E35D/M47V/V68M/L85Q/K89N, A26E/E35D/M47L/V68M/A71G/D90G, H18Y/E35D/M47L/V68M/A71G/D90G, H18Y/A26E/M47L/V68M/A71G/D90G, H18Y/A26E/E35D/V68M/A71G/D90G, H18Y/A26E/E35D/M47L/A71G/D90G, H18Y/A26E/E35D/

M47L/V68M/D90G, H18Y/A26E/E35D/M47L/V68M/A71G, E35D/M47L/V68M/A71G/D90G, H18Y/M47L/V68M/A71G/D90G, H18Y/A26E/V68M/A71G/D90G, H18Y/A26E/E35D/A71G/D90G, H18Y/A26E/E35D/M47L/D90G, H18Y/A26E/E35D/M47L/V68M, A26E/M47L/V68M/A71G/D90G, A26E/E35D/V68M/A71G/D90G, A26E/E35D/M47L/A71G/D90G, A26E/E35D/M47L/V68M/D90G, A26E/E35D/M47L/V68M/A71G, H18Y/E35D/V68M/A71G/D90G, H18Y/E35D/M47L/A71G/D90G, H18Y/E35D/M47L/V68M/D90G, H18Y/E35D/M47L/V68M/A71G, H18Y/A26E/M47L/A71G/D90G, H18Y/A26E/M47L/V68M/D90G, H18Y/A26E/M47L/V68M/A71G, H18Y/A26E/E35D/V68M/D90G, H18Y/A26E/E35D/V68M/A71G, H18Y/A26E/E35D/M47L/A71G, M47L/V68M/A71G/D90G, H18Y/V68M/A71G/D90G, H18Y/A26E/A71G/D90G, H18Y/A26E/E35D/D90G, H18Y/A26E/E35D/M47L, E35D/V68M/A71G/D90G, E35D/M47L/A71G/D90G, E35D/M47L/V68M/D90G, E35D/M47L/V68M/A71G, A26E/V68M/A71G/D90G, A26E/M47L/A71G/D90G, A26E/M47L/V68M/D90G, A26E/M47L/V68M/A71G, A26E/E35D/A71G/D90G, A26E/E35D/V68M/D90G, A26E/E35D/V68M/A71G, A26E/E35D/M47L/D90G, A26E/E35D/M47L/V68M, H18Y/M47L/A71G/D90G, H18Y/M47L/V68M/D90G, H18Y/M47L/V68M/A71G, H18Y/E35D/A71G/D90G, H18Y/E35D/V68M/D90G, H18Y/E35D/V68M/A71G, H18Y/E35D/M47L/D90G, H18Y/E35D/M47L/A71G, H18Y/E35D/M47L/V68M, H18Y/A26E/V68M/D90G, H18Y/A26E/V68M/A71G, H18Y/A26E/M47L/D90G, H18Y/A26E/M47L/A71G, H18Y/A26E/M47L/V68M, H18Y/A26E/E35D/A71G and H18Y/A26E/E35D/V68M, where the position(s) of the amino acid substitution(s) correspond(s) to the positions of CD80 set forth in SEQ ID NO: 2.

In some embodiments, the one or more amino acid substitutions is selected from among V20I, V22I, V22L, A26E, Q27H, Q33L, Q33R, E35D, E35G, T41S, M43L, D46E, D46V, M47I, M47L, M47V, N55D, T57, 161V, L70M, A71D, A71G, L72V, and L85M, L85Q, R94W, and L97Q, where the position(s) of the amino acid substitution(s) correspond(s) to the positions of CD80 set forth in SEQ ID NO: 2. In some embodiments, the one or more amino acid substitutions is selected from among V20I, V22L, A26E, Q27H, Q33L, Q33R, E35D, E35G, M47I, D46E, D46V, M47L, M47V, T57I, L70M, A71D, A71G, L72V, and L85M, L85Q, L97Q, or the one or more amino acid modification is selected from among A26E, Q33L, E35D, M47I, M47L, M47V, T57I, L70M, A71D, A71G, and L85Q; or the one or more amino acid modification is selected from among A26E, E35D, D46V, M47L, M47V, L70M, A71G, and L85Q; or the one or more amino acid modification(s) comprises A26E; or the one or more amino acid modification(s) comprises E35D; or the one or more amino acid modification(s) comprises D46V; or the one or more amino acid modification(s) comprise M47L; or the one or more amino acid modification(s) comprise M47V; or the one or more amino acid modification(s) comprise A71G, where the position(s) of the amino acid substitution(s) correspond(s) to the numbering of positions of CD80 set forth in SEQ ID NO: 2. In some embodiments, the one or more amino acid substitutions is selected from among A26E, Q33L, E35D, M47I, M47L, M47V, T57I, L70M, A71D, A71G, and L85Q, where the position(s) of the amino acid substitution(s) correspond(s) to the positions of CD80 set forth in SEQ ID NO: 2.

In some embodiments, provided herein is a variant CD80 polypeptide containing an IgV domain or a specific binding fragment thereof, an IgC domain or a specific binding fragment thereof, or both, wherein the variant CD80 polypeptide comprises amino acid modifications in an unmodified CD80 or specific binding fragment thereof, wherein the amino acid modifications comprise E35D/D46E, E35D/D46V, E35D/M47I, E35D/M47L, E35D/M47V, E35D/V68M, E35D/A71G or E35D/D90G; D46E/M47I, D46E/M47L, D46E/M47V, D46E/V68M, D46E/A71G or D46E/D90G; M47I/V68M, M47I/A71G, M48I/D90G; M47L/V68M, M47L/A71G, M47L/D90G; M47V/V68M, M47V/A71G, M47V/D90G; V68M/A71G or V68M/D90G; A71G/D90G; or E35D/M47I/V68M, E35D/M47L/V68M, E35D/M47V/V68M, wherein the position(s) of the amino acid modification(s) correspond(s) to the numbering of positions of CD80 set forth in SEQ ID NO: 2

In some embodiments, provided herein is a variant CD80 polypeptide, containing an IgV domain or a specific binding fragment thereof, an IgC domain or a specific binding fragment thereof, or both, wherein the variant CD80 polypeptide contains one or more the amino acid substitutions, the one or more amino acid substitutions containing at least the amino acid substitution L70P but not containing the amino acid substitutions V68M, L72P and/or K86E, where the position(s) of the amino acid substitution(s) correspond(s) to the positions of CD80 set forth in SEQ ID NO: 2. In some embodiments, the one or more amino acid substitution is selected from among: L70P, I30F/L70P, I30V/T57I/L70P/A71D/A91T, N55D/L70P/E77G, and L70P/F92S.

In some embodiments, the unmodified CD80 is a mammalian CD80. In some embodiments, the CD80 is a human CD80.

In some embodiments, the variant CD80 polypeptide contains: the IgV domain or a specific binding fragment thereof, and the IgC domain or a specific binding fragment thereof.

In some embodiments, the unmodified CD80 contains (i) the sequence of amino acids set forth in SEQ ID NO:2, (ii) a sequence of amino acids that has at least 95% sequence identity to SEQ ID NO:2; or (iii) is a portion thereof containing an IgV domain or IgC domain or specific binding fragments thereof. In some embodiments, the specific binding fragment of the IgV domain or the IgC domain has a length of at least 50, 60, 70, 80, 90, 100, 110 or more amino acids; the specific binding fragment of the IgV domain contains a length that is at least 80% of the length of the IgV domain set forth as amino acids 35-135, 35-138, 37-138 or 35-141 of SEQ ID NO:1; or the specific binding fragment of the IgC domain contains a length that is at least 80% of the length of the IgC domain set forth as amino acids 145-230, 154-232, or 142-232 of SEQ ID NO:1.

In some embodiments, the variant CD80 polypeptide contains up to 1, 2, 3, 4, 5, 6, 7, 8, 9, 10, 11, 12, 13, 14, 15, 16, 17, 18, 19 or 20 amino acid modifications, optionally amino acid substitutions, insertions and/or deletions. In some embodiments, the variant CD80 polypeptide contains a sequence of amino acids that exhibits at least 85%, 86%, 87%, 88%, 89%, 90%, 91%, 92%, 93%, 94%, 95%, 96%, 97%, 98% or 99% sequence identity to SEQ ID NO: 2, or a specific binding fragment thereof.

In some embodiments, the variant CD80 polypeptide exhibits altered binding to the ectodomain of CTLA-4, PD-L1 and/or CD28 compared to the binding of the unmodified CD80 for the ectodomain of CTLA-4, PD-L1 and/or CD28. In some embodiments, the altered binding is altered binding affinity and/or altered binding selectivity.

In some embodiments, the variant CD80 polypeptide contains the IgV domain or a specific fragment thereof and the IgC domain or a specific fragment thereof. In some embodiments, the variant CD80 polypeptide contains or consists of the sequence of amino acids set forth in any of SEQ ID NOS: 3-75, 2009-2104, 2297-2507, and 2930-2960 or a specific binding fragment thereof, or a sequence of amino acids that exhibits at least 95% sequence identity to any of SEQ ID NOS: 3-75, 2009-2104, 2297-2507, and 2930-2960, or a specific binding fragment thereof, that contains the one or more of the amino acid substitutions.

In some embodiments, the variant CD80 polypeptide contains the IgV domain or a specific binding fragment thereof. In some embodiments, the IgV domain or specific binding fragment thereof is the only CD80 portion of the variant CD80 polypeptide.

In some embodiments, the variant CD80 polypeptide contains the sequence of amino acids set forth in any of SEQ ID NOS: 77-149, 151-223, 2105-2296, 2508-2929, and 2961-3022, or a specific binding fragment thereof, or a sequence of amino acids that exhibits at least 95% sequence identity to any of SEQ ID NOS: 77-149, 151-223, 2105-2296, 2508-2929, and 2961-3022, or a specific binding fragment thereof, that contains the one or more of the amino acid substitutions.

In some embodiments, the IgC domain or specific binding fragment thereof is the only CD80 portion of the variant CD80 polypeptide.

In some embodiments, the variant CD80 exhibits altered binding affinity and/or altered binding selectivity to the ectodomain of CTLA4, PD-L1, or CD28, compared to the binding specificity of the unmodified CD80 for the ectodomain of CTLA4, PD-L1, or CD28. In some embodiments, the CTLA-4 is a human CTLA-4. In some embodiments, the CD28 is a human CD28. In some embodiments, the PD-L1 is a human PD-L1.

In some embodiments, the variant CD80 exhibits increased binding affinity to the ectodomain of CTLA4 compared to the binding affinity of the unmodified CD80 for the ectodomain of CTLA4. In some embodiments, the increased affinity to the ectodomain of CTLA-4 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to binding affinity of the unmodified CD80 for the ectodomain of CTLA-4.

In some embodiments, the variant CD80 polypeptide contains one or more amino acid modifications in an unmodified CD80 or specific binding fragment thereof, corresponding to position(s) 7, 23, 26, 30, 35, 46, 57, 58, 71, 73, 79, and/or 84, with reference to numbering of SEQ ID NO: 2. In some embodiments, the variant CD80 polypeptide contains one or more amino acid modifications in an unmodified CD80 or specific binding fragment thereof, selected from among E7D, T13A, T13R, S15T, C16R, V20I, V22D, V22L, E23D, E23G, E24D, A26E, A26P, A26S, A26T, Q27H, Q27L, 130V, Q33L, Q33R, E35D, E35G, T41S, M42V, M43L, M43T, D46E, D46V, M47I, M47L, M47V, N48D, N48H, N48K, N48R, N48S, N48T, N48Y, Y53F, K54E, K54R, T57A, T57I, 158V, I61F, I61V, T62A, T62N, I67L, V68E, I69F, L70M, A71D, A71G, L72V, R73H, P74S, T79I, T79M, E81G, E81K, V84I, L85M, L85Q, Y87C, Y87D, E88V, F92V, R94Q, R94W, E95D, E95V, and L97Q, wherein the position(s) of the amino acid substitution(s) correspond(s) to the positions of CD80 set forth in SEQ ID NO: 2.

In any of the provided embodiments, the CD80 polypeptide can exhibit increased binding affinity to the ectodomain of CD28 compared to the binding affinity of the unmodified CD80 for the ectodomain of CD28. In some of such embodiments, the increased affinity to the ectodomain of CD28 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold, 70-fold, 80-fold, 90-fold, 100-fold, 150-fold, or 200-fold, compared to binding affinity of the unmodified CD80 for the ectodomain of CD28. In some of such embodiments, the CD80 polypeptide contains one or more amino acid modifications in an unmodified CD80 or specific binding fragment thereof, corresponding to position(s) 23, 26, 35, 46, 55, 57, 58, 71, 79, and/or 84, with reference to numbering of SEQ ID NO: 2. In some of such embodiments, the CD80 polypeptide contains one or more amino acid modifications in an unmodified CD80 or specific binding fragment thereof, selected from among T13R, S15T, V20I, V22D, V22L, E23D, E23G, E24D, A26E, A26P, A26S, A26T, Q27H, Q27L, Q33R, E35D, E35G, T41S, M42V, M43L, D46E, D46V, M47I, M47L, M47V, N48K, N48Y, Y53F, K54E, N55I, T57A, T57, 158V, I61F, I61V, T62A, T62N, I67L, V68E, V68L, I69F, L70M, A71D, A71G, L72V, T79I, T79M, V84I, L85M, L85Q, Y87C, Y87D, E88V, R94Q, R94W, E95V, and L97Q, wherein the position(s) of the amino acid substitution(s) correspond(s) to the positions of CD80 set forth in SEQ ID NO: 2.

In some embodiments, the variant CD80 polypeptide exhibits increased binding affinity to the ectodomain of PD-L1 compared to the binding affinity of the unmodified CD80 for the ectodomain of PD-L1. In some of such embodiments, the increased affinity to the ectodomain of PD-L1 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100-fold, 150-fold, 200-fold, 250-fold, 300-fold, 350-fold, 400-fold, or 450-fold compared to binding affinity of the unmodified CD80 for the ectodomain of PD-L1. In some of such embodiments, the CD80 polypeptide contains one or more amino acid modifications in an unmodified CD80 or specific binding fragment thereof, corresponding to position(s) 7, 23, 26, 30, 34, 35, 46, 51, 55, 57, 58, 65, 71, 73, 78, 79, 82, and/or 84, with reference to numbering of SEQ ID NO: 2. In some embodiments, the CD80 polypeptide contains one or more amino acid modifications in an unmodified CD80 or specific binding fragment thereof, selected from among E7D, T13A, T13R, S15T, C16R, V20A, V20I, V22D, V22I, V22L, E23D, E23G, E24D, L25S, A26E, A26P, A26S, A26T, Q27H, Q27L, 130T, 130V, Q33E, Q33K, Q33L, Q33R, K34E, E35D, K36R, T41S, M421, M42V, M43L, M43T, D46E, D46V, M47I, M47L, M47V, N48D, N48H, N48K, N48R, N48S, N48T, N48Y, P51A, Y53F, K54R, N55D, N55I, T57, 158V, I61F, I61V, T62A, T62N, L65P, I67L, V68L, I69F, L70M, A71D, A71G, L72V, R73S, P74S, D76H, G78A, T79A, T79I, T79L, T79M, T79P, E81G, E81K, C82R, V84A, V84I, L85E, L85M, L85Q, K86M, Y87C, Y87D, F92S, F92V, R94Q, R94W, E95D, E95V, L97M, and L97Q, wherein the position(s) of the amino acid substitution(s) correspond(s) to the positions of CD80 set forth in SEQ ID NO: 2.

In some embodiments, the variant CD80 exhibits decreased binding affinity to the ectodomain of CD28 compared to the binding affinity of the unmodified CD80 for the ectodomain of CD28. In some embodiments, the decreased affinity to the ectodomain of CD28 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to binding affinity of the unmodified CD80 for the ectodomain of CD28.

In some embodiments, the variant CD80 polypeptide specifically binds to the ectodomain of CTLA-4 with increased selectivity compared to the unmodified CD80 for the ectodomain of CTLA-4. In some of such embodiments, the increased selectivity includes a greater ratio of binding of the variant polypeptide for CTLA-4 versus CD28 compared to the ratio of binding of the unmodified CD80 polypeptide for CTLA-4 versus CD28. In some of such embodiments, the ratio of binding CTLA-4 versus CD28 is greater by at least or at least about 1.5-fold, 2.0-fold, 3.0-fold, 4.0-fold, 5-fold, 10-fold, 15-fold, 20-fold, 30-fold, 40-fold, 50-fold or more.

In any of the provided embodiments, the variant CD80 polypeptide specifically binds to the ectodomain of PD-L1 with increased selectivity compared to the unmodified CD80 of the ectodomain of PD-L1. In some of such embodiments, the increased selectivity includes a greater ratio of binding of the variant polypeptide for PD-L1 versus CD28 compared to the ratio of binding of the unmodified CD80 polypeptide for PD-L1 versus CD28. In some of such embodiments, the ratio is greater by at least or at least about 1.5-fold, 2.0-fold, 3.0-fold, 4.0-fold, 5-fold, 10-fold, 15-fold, 20-fold, 30-fold, 40-fold, 50-fold or more.

In some embodiments, the variant CD80 polypeptide is a soluble protein. In some embodiments, the variant CD80 polypeptide is linked to a multimerization domain. In some embodiments, the variant CD80 polypeptide is a multimeric polypeptide, optionally a dimeric polypeptide, containing a first variant CD80 polypeptide linked to a multimerization domain and a second variant CD80 polypeptide linked to a multimerization domain. In some embodiments, the first variant CD80 polypeptide and the second variant CD80 polypeptide are the same. I some embodiments, the first variant CD80 polypeptide and the second variant CD80 polypeptide are different.

In some embodiments, the multimerization domain is an Fc domain or a variant thereof with reduced effector function. In some embodiments, the variant CD80 polypeptide is linked to a moiety that increases biological half-life of the polypeptide. In some embodiments, the variant CD80 polypeptide is linked to an Fc domain or a variant thereof with reduced effector function.

In some embodiments, the Fe domain is mammalian, optionally human; or the variant Fe domain contains one or more amino acid modifications compared to an unmodified Fc domain that is mammalian, optionally human. In some embodiments, the Fc domain or variant thereof contains the sequence of amino acids set forth in SEQ ID NO:277, SEQ ID NO:359, or SEQ ID NO: 1712, or a sequence of amino acids that exhibits at least 85% sequence identity to SEQ ID NO:277, SEQ ID NO:359, or SEQ ID NO: 1712. In some embodiments, the Fc domain contains one or more amino acid modifications selected from among E233P, L234A, L234V, L235A, L235E, G236del, G237A, S267K, N297G, V302C, and K447del, each by EU numbering. In some embodiments, wherein the Fc region is not a human IgG1 Fc containing the mutations R292C, N297G and V302C (corresponding to R77C, N82G and V87C with reference to wild-type human IgG1 Fc set forth in SEQ ID NO: 277). In some embodiments, the Fc is not the Fc set forth in SEQ ID NO:356. In some embodiments, the Fc domain contains the amino acid modification C220S by EU numbering. In some embodiments, the Fc domain contains the sequence of amino acids set forth in any of SEQ ID NOS: 356-358, 376, and 1713-1715 or a sequence of amino acids that exhibits at least 85% sequence identity to any of SEQ ID NOS: 356-358, 376, and 1713-1715 and exhibits reduced effector function. In some embodiments, the variant CD80 polypeptide is linked to the multimerization domain or Fc indirectly via a linker, optionally a GSG4S linker (SEQ ID NO: 1716). In some embodiments, the linker does not consist of three alanines (AAA).

In some embodiments, provided herein is an immunomodulatory protein, containing the any of the variant CD80 polypeptides provided herein and a half-life extending moiety. In some embodiments, the half-life extending moiety contains a multimerization domain, albumin, an albumin-binding polypeptide, Pro/Ala/Ser (PAS), a C-terminal peptide (CTP) of the beta subunit of human chorionic gonadotropin, polyethylene glycol (PEG), long unstructured hydrophilic sequences of amino acids (XTEN), hydroxyethyl starch (HES), an albumin-binding small molecule, or a combination thereof. In some embodiments, the half-life extending moiety is or contains Pro/Ala/Ser (PAS) and the variant CD80 polypeptide is PASylated. In some embodiments, the half-life extending moiety is or contains a multimerization domain. In some embodiments, the multimerization domain is selected from an Fc region of an immunoglobulin, a leucine zipper, an isoleucine zipper or a zinc finger.

In some embodiments, the immunomodulatory protein is a multimer containing a first variant CD80 polypeptide linked to a first multimerization domain and a second variant CD80 polypeptide linked to a second multimerization domain, wherein the first and second multimerization domains interact to form a multimer containing the first and second variant CD80 polypeptide. In some embodiments, the multimer is a dimer. In some embodiments, the first variant CD80 polypeptide and the second variant CD80 polypeptide are the same. In some embodiments, the dimer is a homodimer. In some embodiments, the dimer is a heterodimer.

In some embodiments, the multimerization domain is or contains an Fc region of an immunoglobulin. In some embodiments, the Fc region is of an immunoglobulin G1 (IgG1) or an immunoglobulin G2 (IgG2) protein. In some embodiments, the immunoglobulin protein is human and/or the Fc region is human. In some embodiments, the Fc region contains the sequence of amino acids set forth in SEQ ID NO: 278 or a variant thereof that exhibits at least 90%, 91%, 92%, 93%, 94%, 95%, 96%, 97%, 98% or 99% sequence identity to SEQ ID NO:278. In some embodiments, the Fc region contains the sequence of amino acids set forth in SEQ ID NO: 277 or a variant thereof that exhibits at least 90%, 91%, 92%, 93%, 94%, 95%, 96%, 97%, 98% or 99% sequence identity to SEQ ID NO:277.

In some embodiments, the Fc region exhibits one or more effector functions. In some embodiments, the immunomodulatory protein exhibits Fc-dependent CD28 costimulation, optionally in a T cell stimulation assay in the presence of antigen presenting cells, optionally wherein the T cells comprise Jurkat cells expressing an IL-2 reporter. In some embodiments, the Fc region exhibits one or more reduced effector function compared to a wildtype Fc region, optionally wherein the wildtype Fc region is a human Fc of human IgG1. In some embodiments, the one or more effector function is selected from among antibody dependent cellular cytotoxicity (ADCC), complement dependent cytotoxicity, programmed cell death and cellular phagocytosis.

In some embodiments, the Fc region is a variant Fc region containing one or more amino acid substitutions compared to the wildtype Fc region. In some of such embodiments, the one or more amino acid substitutions of the variant Fc region are selected from Fc N297G, R292C/N297G/V302C, E233P/L234V/L235A/G236del/S267K or L234A/L235E/G237A, wherein the residue is numbered according to the EU index of Kabat. In some embodiments, the variant Fc region further contains the amino acid substitution C220S, wherein the residues are numbered according to the EU index of Kabat. In some embodiments, the Fc region contains the sequence of amino acid sequence set forth in any of SEQ ID NOS: 356-358 or a sequence of amino acids that exhibits at least 90%, 91%, 92%, 93%, 94%, 95%, 96%, 97%, 98%, 99% or more sequence identity to any of SEQ ID NOS: 356-358 and contains the amino acid substitutions. In some embodiments, the Fc region contains K447del, wherein the residue is numbered according to the EU index of Kabat. In some embodiments, the Fc region contains the sequence of amino acid sequence set forth in any of SEQ ID NOS: 1713-1715 or a sequence of amino acids that exhibits at least 90%, 91%, 92%, 93%, 94%, 95%, 96%, 97%, 98%, 99% or more sequence identity to any of SEQ ID NOS: 1713-1715 and contains the amino acid substitutions.

In some embodiments, the immunomodulatory protein contains any of the variant CD80 polypeptides provided herein that exhibits increased affinity for PD-L1.

In some embodiments, the immunomodulatory protein exhibits PD-L1-dependent CD28 costimulation, optionally in a T cell stimulation assay in the presence of antigen presenting cells expressing PD-L1, optionally wherein the T cells comprise Jurkat cells expressing an IL-2 reporter or primary human T cells producing inflammatory cytokines such as IL-2.

In some embodiments of the immunomodulatory protein, the variant CD80 polypeptide is linked, directly or indirectly via a linker, to the multimerization domain. In some of such embodiments, the linker contains 1 to 10 amino acids. In some embodiments, the linker is selected from AAA, G4S (SEQ ID NO:1717) or $(G4S)_2$ (SEQ ID NO:330).

In some embodiments, the variant CD80 polypeptide is a transmembrane immunomodulatory protein further containing a transmembrane domain linked to the extracellular domain (ECD) or specific binding fragment thereof of the variant CD80 polypeptide. In some embodiments, the transmembrane domain contains the sequence of amino acids set forth as residues 243-263 of SEQ ID NO:1 or a functional variant thereof that exhibits at least 85% sequence identity to residues 243-263 of SEQ ID NO:1. In some embodiments, the variant CD80 polypeptide further contains a cytoplasmic signaling domain linked to the transmembrane domain. In some embodiments, the cytoplasmic signaling domain contains the sequence of amino acids set forth as residues 264-288 of SEQ ID NO:1 or a functional variant thereof that exhibits at least 85% sequence identity to residues 254-288 of SEQ ID NO:1.

In some of any of the provided embodiments, the variant CD80 polypeptide modulates a response of an immune cell, such as a T cell. In some embodiments, the response, e.g., T cell response, is increased or is decreased. In some embodiments, the variant CD80 increases IFN-gamma (interferon-gamma) expression relative to the unmodified CD80 in an in vitro primary T-cell assay. In some embodiments, the variant CD80 decreases IFN-gamma (interferon-gamma) expression relative to the unmodified CD80 in an in vitro primary T-cell assay. In some embodiments of any one of the variant CD80 polypeptides described herein, the variant CD80 polypeptide increases T cell signaling relative to the unmodified CD80, such as determined using a reporter assay involving a T cell (e.g., Jurkat) engineered with a reporter (e.g., luciferase) operably connected to an IL-2 promoter. In some embodiments of any one of the variant CD80 polypeptides described herein, the variant CD80 polypeptide decreases T cell signaling relative to the unmodified CD80, such as determined using a reporter assay involving a T cell (e.g., Jurkat) engineered with a reporter (e.g., luciferase) operably connected to an IL-2 promoter. In some of any such embodiments, the variant CD80 polypeptide is provided in any of a variety of formats, such as soluble or immobilized (e.g., plate-bound).

In some embodiments, the variant CD80 polypeptide is deglycosylated.

In some embodiments, provided herein is an immunomodulatory protein, containing any of the provided variant CD80 polypeptide linked to a second polypeptide containing an immunoglobulin superfamily (IgSF) domain. In some embodiments, the IgSF domain is affinity modified and exhibits altered binding to one or more of its cognate binding partner(s) compared to the unmodified or wild-type IgSF domain. In some embodiments, the IgSF domain exhibits increased binding to one or more of its cognate binding partner(s) compared to the unmodified or wild-type IgSF domain.

In some embodiments, the variant CD80 is a first CD80 variant polypeptide and the IgSF domain of the second polypeptide is an IgSF domain from a second variant CD80 polypeptide that is any of the variant CD80 polypeptides provided herein, wherein the first and second CD80 variant are the same or different. In some embodiments, the variant CD80 polypeptide is capable of specifically binding to CTLA-4 and the IgSF domain of the second polypeptide is capable of binding to a cognate binding partner other than one specifically bound by the CD80 variant polypeptide. In some embodiments, the IgSF domain of the second polypeptide is a tumor-localizing moiety that binds to a ligand expressed on a tumor. In some embodiments, the ligand expressed on a tumor is B7H6.

In some embodiments, the IgSF domain is from NKp30.

In some embodiments, the IgSF domain of the second polypeptide is an IgSF domain of a ligand that binds to an inhibitory receptor, or is an affinity-modified IgSF domain thereof. In some embodiments, the affinity-modified IgSF domain exhibits increased binding affinity and/or binding selectivity for the inhibitory receptor compared to binding of the unmodified IgSF domain to the inhibitory receptor. In some embodiments, the inhibitory receptor is TIGIT or PD-1; or the ligand of the inhibitory receptor is CD155, CD112, PD-L1 or PD-L2.

In some embodiments, the IgSF domain of the second polypeptide is an affinity-modified IgSF domain containing: (i) a wildtype CD112 comprising an IgSF domain set forth in any of SEQ ID NOS: 269, 734 or 829 or a variant CD112 polypeptide containing an IgSF domain of any of SEQ ID NOS set forth in Table 3, optionally any of the SEQ ID NO: 735-828, 830-917, 918-999, 1430-1501; (ii) a wildtype CD155 comprising an IgSF set forth in any of SEQ ID NOS:268, 378 or 421 or a variant CD155 polypeptide containing an IgSF domain of any of SEQ ID NOS set forth in Table 4, optionally any of the SEQ ID NO: 379-420, 422-539, 540-733, 1502-1573, 1548-1711, (iii) a wildtype PD-L1 comprising an IgSF set forth in any of SEQ ID NOS: 251, 1000, 1721 or 1196 or a variant PD-L1 polypeptide containing an IgSF of any of SEQ ID NOS set forth in Table 5, optionally any of the SEQ ID NO: 1001-1065, 1718-1900, 1931-1996; (iv) a wildtype PD-L2 comprising an IgSF set forth in any of SEQ ID NOS: 252, 1197 or 1257 variant PD-L2 polypeptide containing an IgSF domain of any of SEQ ID NOS set forth in Table 6, optionally any of the SEQ ID NO: 1198-1248, 1250-1325, 1327-1401, 1403-1426 1719, 1720, 1901-1930, (v) a sequence of amino acids that exhibits at least 90%, 91%, 92%, 93%, 94%, 95%, 95%, 97%, 98%, 99% or more sequence identity to any of the SEQ ID NOSs in (i)-(iv) and that contains the amino acid substitution; or (vi) a specific binding fragment of any of (i)-(v). In some embodiments, the IgSF domain is or contains an IgV domain. In some embodiments, the variant CD80 polypeptide is or contains an IgV domain.

In some embodiments, the immunomodulatory protein contains a multimerization domain linked to one or both of the variant CD80 polypeptide and the IgSF domain of the second polypeptide. In some embodiments, the multimerization domain is an Fc domain or a variant thereof with reduced effector function. In some embodiments, the immunomodulatory protein is dimeric. In some embodiments, the immunomodulatory protein is homodimeric. In some embodiments, the immunomodulatory protein is heterodimeric.

In some embodiments, provided herein is a conjugate, containing a variant CD80 polypeptide provided herein or an immunomodulatory polypeptide provided herein linked to a moiety. In some embodiments, the moiety is a targeting moiety that specifically binds to a molecule on the surface of a cell. In some embodiments, the targeting moiety specifically binds to a molecule on the surface of an immune cell, optionally wherein the immune cell is an antigen presenting cell or a lymphocyte. In some embodiments, the immune cell is an antigen presenting cell or a lymphocyte. In some embodiments, the targeting moiety is a tumor-localizing moiety that binds to a molecule on the surface of a tumor. In some embodiments, the moiety is a protein, a peptide, nucleic acid, small molecule or nanoparticle. In some embodiments, the moiety is an antibody or antigen-binding fragment. In some embodiments, the conjugate is divalent, tetravalent, hexavalent or octavalent. Exemplary depictions of such conjugates are presented in FIGS. 6A and 6B. In some embodiments, the conjugate is a fusion protein.

In some embodiments, provided herein is a nucleic acid molecule(s), encoding a variant CD80 polypeptide provided herein, an immunomodulatory polypeptide provided herein, or a conjugate that is a fusion protein containing any of the variant CD80 polypeptides provided herein. In some embodiments, the nucleic acid molecule is synthetic nucleic acid. In some embodiments, the nucleic acid molecule is cDNA.

In some embodiments, provided herein is a vector, containing the nucleic acid molecule provided herein. In some embodiments, the vector is an expression vector. In some embodiments, the vector is a mammalian expression vector or a viral vector.

In some embodiments, provided herein is a cell, containing a vector provided herein. In some embodiments, the cell is a mammalian cell. In some embodiments, the cell is a human cell.

In some embodiments, provided herein is a method of producing a variant CD80 polypeptide or an immunomodulatory protein, containing introducing the nucleic acid molecule provided herein or vector provided herein into a host cell under conditions to express the protein in the cell. In some embodiments, the method further includes isolating or purifying the variant CD80 polypeptide or immunomodulatory protein from the cell.

In some embodiments, provided herein is a method of engineering a cell expressing a variant CD80 variant polypeptide that includes introducing a nucleic acid molecule encoding the variant CD80 polypeptide provided herein into a host cell under conditions in which the polypeptide is expressed in the cell.

In some embodiments, provided herein is an engineered cell, expressing a variant CD80 polypeptide provided herein, an immunomodulatory protein provided herein, a conjugate provided herein, the nucleic acid molecule provided herein or the vector provided herein.

In some embodiments, the variant CD80 polypeptide or immunomodulatory protein contains a signal peptide. In some embodiments, the variant CD80 polypeptide or immunomodulatory protein does not contain a transmembrane domain and/or is not expressed on the surface of the cell. In some embodiments, the variant CD80 polypeptide or immunomodulatory protein is secreted from the engineered cell.

In some embodiments, the engineered cell contains a variant CD80 polypeptide that contains a transmembrane domain and/or is a transmembrane immunomodulatory protein provided herein. In some embodiments, the variant CD80 polypeptide is expressed on the surface of the cell. In some embodiments, the engineered cell is an immune cell. In some embodiments, the immune cell is an antigen presenting cell (APC) or a lymphocyte.

In some embodiments, the engineered cell is a primary cell. In some embodiments, the cell is a mammalian cell. In some embodiments, the cell is a human cell. In some embodiments, the cell is a lymphocyte that is a T cell. In some embodiments, the cell is an APC that is an artificial APC. In some embodiments, the engineered cell further contains a chimeric antigen receptor (CAR) or an engineered T-cell receptor.

In some embodiments, provided herein is an infectious agent, containing a nucleic acid molecule encoding a variant CD80 polypeptide provided herein, an immunomodulatory polypeptide provided herein, or a variant CD80 fusion conjugate provided herein. In some embodiments, the encoded variant CD80 polypeptide or immunomodulatory polypeptide does not contain a transmembrane domain and/or is not expressed on the surface of a cell in which it is expressed. In some embodiments, the encoded variant CD80 polypeptide, immunomodulatory polypeptide, or conjugate is secreted from a cell in which it is expressed.

In some embodiments, the encoded variant CD80 polypeptide contained within the infectious agent contains a transmembrane domain. In some embodiments, the encoded variant CD80 polypeptide is expressed on the surface of a cell in which it is expressed.

In some embodiments, the infectious agent is a bacterium or a virus. In some embodiments, the virus is a lentiviral or retroviral construct or a hybrid thereof. In some embodiments, the virus is an oncolytic virus. In some embodiments, the oncolytic virus is an adenovirus, adeno-associated virus, herpes virus, Herpes Simplex Virus, Reovirus, Newcastle Disease virus, parvovirus, measles virus, vesicular stomatitis virus (VSV), Coxsackie virus or a Vaccinia virus.

In some embodiments, the infectious agent is a virus that specifically targets dendritic cells (DCs) and/or is dendritic cell-tropic. In some embodiments, the virus is a lentiviral vector that is pseudotyped with a modified Sindbis virus envelope product.

In some embodiments, the infectious agent further contains a nucleic acid molecule encoding a further gene product that results in death of a target cell or that can augment or boost an immune response. In some embodiments, the further gene product is selected from an anticancer agent, an anti-metastatic agent, an antiangiogenic agent, an immunomodulatory molecule, an immune checkpoint inhibitor, an antibody, a cytokine, a growth factor, an antigen, a cytotoxic gene product, a pro-apoptotic gene product, an anti-apoptotic gene product, a cell matrix degradative gene, genes for tissue regeneration and reprogramming human somatic cells to pluripotency.

In some embodiments, provided herein is a pharmaceutical composition, containing a variant CD80 polypeptide provided herein, an immunomodulatory protein provided herein, a conjugate provided herein, an engineered cell provided herein, or an infectious agent provided herein. In some embodiments, the pharmaceutical composition contains a pharmaceutically acceptable excipient. In some embodiments, the pharmaceutical composition is sterile.

In some embodiments, provided herein is an article of manufacture containing the pharmaceutical composition provided herein in a vial. In some embodiments, the vial is sealed.

In some embodiments, provided herein is a kit containing a pharmaceutical composition provided herein, and instructions for use. In some embodiments, provided herein is a kit containing an article of manufacture provided herein, and instructions for use.

In some embodiments, provided herein is a method of modulating an immune response in a subject, such as increasing or decreasing an immune response, containing administering a pharmaceutical composition provided herein to the subject.

In some embodiments, provided herein is a method of modulating an immune response in a subject that includes administering an immunomodulatory protein provided herein, such as an immunomodulatory protein that exhibits increased binding affinity to PD-L1. In some embodiments, the immune response is increased. In some embodiments, the immunomodulatory protein is an immunomodulatory protein provided herein that exhibits Fc-dependent CD28 costimulation. In some embodiments, the immunomodulatory protein is an immunomodulatory protein provided herein that exhibits PD-L1-dependent CD28 costimulation, optionally wherein the immunomodulatory protein contains a variant CD80 polypeptide provided herein.

In some embodiments, provided herein is a method of modulating an immune response in a subject, containing administering the engineered cells provided herein. In some embodiments, the engineered cells are autologous to the subject. In some embodiments, the engineered cells are allogenic to the subject.

Also provided herein is a method of modulating an immune response in a subject, e.g., increasing or decreasing an immune response, including administering to the subject a variant CD80 polypeptide, or an immunomodulatory protein or conjugate containing the variant CD80 polypeptide or an engineered cell or infectious agent secreting or expressing the variant CD80 polypeptide, wherein the variant CD80 polypeptide binds to CTLA-4 with increased affinity or selectively compared to binding of the unmodified CD80 to the CTLA-4. In some embodiments, the variant CTLA-4 polypeptide contains one or more modifications as described herein.

In some embodiments of the method, the variant CTLA-4 polypeptide contains one or more amino acid modifications at one or more positions in an unmodified CD80 polypeptide or a specific binding fragment thereof corresponding to positions selected from 12, 13, 16, 18, 20, 22, 23, 24, 25, 26, 27, 30, 31, 33, 34, 35, 36, 38, 41, 42, 43, 44, 46, 47, 48, 51, 54, 55, 57, 58, 61, 62, 65, 67, 68, 69, 70, 71, 72, 73, 76, 77, 78, 79, 81, 82, 83, 84, 85, 86, 88, 90, 91, 92, 93, 94, and/or 95 with reference to positions set forth in SEQ ID NO:2. In some embodiments, the variant CD80 polypeptide contains one or more amino acid modifications at one or more positions in an unmodified CD80 or specific binding fragment thereof, corresponding to position(s) 23, 26, 30, 34, 35, 46, 51, 55, 57, 58, 65, 71, 73, 78, 79, 82, or 84 with reference to numbering of SEQ ID NO: 2.

In some embodiments, the one or more modifications are selected from A12T, A12V, T13R, C16R, H18Y, V20I, V22I, V22L, E23D, E23G, E24D, L25S, A26E, A26P, A26S, A26T, Q27H, Q27L, 30F, 130T, 130V, Y31H, Q33E, K34E, E35D, E35G, K36R, M38V, T41A, T41S, M42I, M42V, M43I, M43L, S44P, D46E, D46V, M47I, M47L, M47T, M47V, N48H, P51A, K54E, N55D, N55I, T57A, T57I, 158V, I61V, T62N, L65P, I67L, V68A, V68L, V68M, I69F, I69T, L70M, L70P, L70Q, L70R, A71D, A71G, L72P, L72V, R73S, D76H, E77G, G78A, T79I, T79P, E81K, C82R, V83I, V84A, V84I, L85M, L85Q, K86M, E88D, E88V, D90N, A91S, A91T, F92S, K93R, R94W, E95K and E95V. In some embodiments, the variant CD80 polypeptide contains one or more amino acid substitutions in an unmodified CD80 or specific binding fragment thereof, selected from among E23D, E23G, A26E, A26P, A26S, A26T, I30F, I30T, I30V, K34E, E35D, E35G, D46E, D46V, P51A, N55D, N55I, T57A, T57, 158V, L65P, A71D, A71G, R73S, G78A, T79I, T79P, C82R, V84A, V84I, wherein the position(s) of the amino acid substitution(s) correspond(s) to the numbering of positions of CD80 set forth in SEQ ID NO: 2

In some embodiments, the one or more modifications are selected from L70P, 130F/L70P, Q27H/T41S/A71D, 130T/L70R, T13R/C16R/L70Q/A71D, T57I, M43I/C82R, V22L/M38V/M47T/A71D/L85M, I30V/T57I/L70P/A71D/A91T, V22I/L70M/A71D, N55D/L70P/E77G, T57A/I69T, N55D/K86M, L72P/T79I, L70P/F92S, T79P, E35D/M47I/L65P/D90N, L25S/E35D/M47I/D90N, S44P/I67T/P74S/E81G/E95D, A71D, T13A/I61N/A71D, E81K/A91S, A12V/M47V/L70M, K34E/T41A/L72V, T41S/A71D/V84A, E35D/A71D, E35D/M47I, K36R/G78A, Q33E/T41A, M47V/N48H, M47L/V68A, S44P/A71D, Q27H/M43I/A71D/R73S, E35D/T57I/L70Q/A71D, M47I/E88D, M42I/I61V/A71D, P51A/A71D, H18Y/M47I/T57I/A71G, V20I/M47V/T57I/V84I, V20I/M47V/A71D, A71D/L72V/E95K, V22L/E35G/A71D/L72P, E35D/A71D, E35D/I67L/A71D, Q27H/E35G/A71D/L72P/T79I, T13R/M42V/M47I/A71D, E35D, E35D/M47I/L70M, E35D/A71D/L72V, E35D/M43L/L70M, A26P/E35D/M43I/L85Q/E88D, E35D/D46V/L85Q, Q27L/E35D/M47I/T57I/L70Q/E88D, M47V/I69F/A71D/V83I, E35D/T57A/A71D/L85Q, H18Y/A26T/E35D/A71D/L85Q, E35D/M47L, E23D/M42V/M43I/I58V/L70R, V68M/L70M/A71D/E95K, N55I/T57I/I69F, E35D/M43I/A71D, T41S/T57I/L70R, H18Y/A71D/L72P/E88V, V20I/A71D, E23G/A26S/E35D/T62N/A71D/L72V/L85M, A12T/E24D/E35D/D46V/I61V/L72P/E95V, V22L/E35D/M43L/A71G/D76H, E35G/K54E/A71D/L72P, L70Q/A71D, A26E/E35D/M47L/L85Q, D46E/A71D, and Y31H/E35D/T41S/V68L/K93R/R94W.

In some embodiments, the method includes administering to the subject a soluble variant CD80 polypeptide according to any one of the embodiments described herein, an immunomodulatory protein according to any one of the embodiments described or a conjugate according to any one of the embodiments described herein. In some embodiments, the method includes administering to the subject an infectious agent encoding a variant CD80 polypeptide according to any one of the embodiments described herein.

In some embodiments, modulating the immune response treats a disease or condition in the subject. In some embodiments, the immune response is increased. Various formats of a variant CD80 polypeptide are contemplated for administration to a subject to increase an immune response, such as antagonist formats of a variant CD80. In some cases, such methods are carried out under conditions in which signaling by the inhibitory receptor CTLA-4 is blocked or attenuated by the administration.

In some embodiments, in the provided methods of modulating an immune response, a variant CD80 polypeptide or immunomodulatory protein that is soluble is administered to the subject. In some embodiments, the soluble immunomodulatory protein is an immunomodulatory Fc fusion protein.

In some embodiments, the provided methods include administering a variant CD80 polypeptide provided herein, or an immunomodulatory protein provided herein, to the subject. In some embodiments, an engineered cell containing a secretable variant CD80 polypeptide provided herein is administered to the subject. In some embodiments, an engineered cell provided herein is administered to the subject.

In some embodiments of the provided methods, an infectious agent encoding a variant CD80 polypeptide that is a secretable immunomodulatory protein is administered to the subject, optionally under conditions in which the infectious agent infects a tumor cell or immune cell and the secretable immunomodulatory protein is secreted from the infected cell.

In some embodiments of the provided methods, the disease or condition is a tumor or cancer. In some embodiments, the disease or condition is selected from melanoma, lung cancer, bladder cancer, a hematological malignancy, liver cancer, brain cancer, renal cancer, breast cancer, pancreatic cancer, colorectal cancer, spleen cancer, prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer. In some of any such embodiments, the variant CD80 is administered in a format that increases an immune response in the subject.

Various formats of a variant CD80 polypeptide are contemplated for administration to a subject to decrease an immune response, such as agonist formats of a variant CD80. In some cases, such methods are carried out under conditions in which signaling by the inhibitory receptor CTLA-4 is activated or stimulated or induced by the administration.

In some embodiments of the provided methods, the immune response is decreased. In some embodiments of the provided methods, an immunomodulatory protein or conjugate containing a variant CD80 polypeptide linked to a moiety that localizes to a cell or tissue of an inflammatory environment is administered to the subject. In some embodiments, the binding molecule contains an antibody or an antigen-binding fragment thereof or contains a second polypeptide containing a wild-type IgSF domain or variant thereof.

In some embodiments of the provided methods, an immunomodulatory protein provided herein or a conjugate provided herein is administered to the subject. In some embodiments of the provided methods, a variant CD80 polypeptide that is a transmembrane immunomodulatory protein is administered to the subject. In some embodiments of the provided methods, an engineered cell containing a variant CD80 polypeptide that is a transmembrane immunomodulatory protein provided herein is administered to the subject.

In some embodiments of the provided methods, an infectious agent encoding a variant CD80 polypeptide that is a transmembrane immunomodulatory protein is administered to the subject, optionally under conditions in which the infectious agent infects a tumor cell or immune cell and the transmembrane immunomodulatory protein is expressed on the surface of the infected cell.

In some embodiments of the provided methods, the disease or condition is an inflammatory or autoimmune disease or condition. In some embodiments, the disease or condition is an Antineutrophil cytoplasmic antibodies (ANCA)-associated vasculitis, a vasculitis, an autoimmune skin disease, transplantation, a Rheumatic disease, an inflammatory gastrointestinal disease, an inflammatory eye disease, an inflammatory neurological disease, an inflammatory pulmonary disease, an inflammatory endocrine disease, or an autoimmune hematological disease. In some embodiments, the disease or condition is selected from inflammatory bowel disease, transplant, Crohn's disease, ulcerative colitis, multiple sclerosis, asthma, rheumatoid arthritis, or psoriasis. In some of any such embodiments, the variant CD80 is administered in a format that decreases an immune response in the subject.

In some embodiments, provided herein is a method of treating a disease or condition including administering an immunomodulatory protein, containing a variant CD80 polypeptide, containing one or more amino acid modifications at one or more position sin the IgV domain or IgC domain or a specific binding fragment thereof of in an unmodified CD80 or specific binding fragment thereof, wherein the immunomodulatory protein exhibits PD-L1 dependent CD28 costimulation. In some embodiments, the variant CD80 polypeptide exhibits increased binding affinity to the ectodomain of PD-L1 compared to the binding affinity of the unmodified CD80 for the ectodomain of PD-L1. In some embodiments, provided herein is a method of mediating CD28 agonism by PD-L1-dependent CD28 costimulation in a subject, the method comprising administering an immunomodulatory protein comprising a variant CD80 polypeptide, said variant CD80 polypeptide comprising one or more amino acid modifications at one or more positions in the IgV domain or IgC domain or the specific binding fragment thereof of an unmodified CD80 or specific binding fragment thereof, wherein the variant CD80 polypeptide exhibits increased binding affinity to the ectodomain of PD-L1 compared to the binding affinity of the unmodified CD80 for the ectodomain of PD-L1. In any of the embodiments, the increased affinity to the ectodomain of PD-L1 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to binding affinity of the unmodified CD80 for the ectodomain of PD-L1.

In some embodiments the method is for use in treating a disease or condition. In some embodiments, PD-L1-dependent CD28 costimulation is assessed in a T cell stimulation assay in the presence of antigen presenting cells expressing PD-L1, optionally wherein the T cell stimulation assay is an in vitro assay, optionally wherein the T cells comprise Jurkat cells expressing an IL-2 reporter or primary human T cells producing inflammatory cytokines such as IL-2.

In some embodiments of the provided methods, prior to the administering, a subject for treatment is selected that has a tumor comprising cells positive for surface PD-L1, optionally wherein the cells are tumor cells or tumor infiltrating immune cells; or the subject has been selected as having a tumor comprising cells surface positive for PD-L1, optionally wherein the cells are tumor cells or tumor infiltrating immune cells.

In some embodiments, selecting a subject comprises (a) contacting a tumor tissue sample from a subject with a binding reagent capable of specifically binding the ectodomain of PD-L1; (b) detecting the presence of the bound binding reagent in or on cells of the tumor tissue sample, optionally wherein the cells are tumor cells or tumor infiltrating immune cells; and (c) if the tumor tissue sample comprises a detectable level of cells surface positive for PD-L1, selecting the subject for treatment.

In some embodiments of the provided methods, prior to the administering, a subject for treatment is selected that has a tumor comprising cells surface positive for CD28, optionally wherein the cells are tumor infiltrating lymphocytes, optionally wherein the lymphocytes are T cells, optionally CD8+ T cells; or the subject has been selected as having a tumor comprising cells surface positive for CD28, optionally wherein the cells are tumor infiltrating lymphocytes, optionally wherein the lymphocytes are T cells, optionally CD8+ T cells.

In some embodiments, selecting the subject includes (a) contacting a tumor tissue sample from a subject with a binding reagent capable of specifically binding the ectodomain of CD28; (b) detecting the presence of the bound binding reagent in or on cells of the tumor tissue sample, optionally wherein the cells are tumor infiltrating lymphocytes, optionally wherein the lymphocytes are T cells, optionally CD8+ T cells; and (c) if the tumor tissue sample comprises a detectable level of cells surface positive for CD28, selecting the subject for treatment.

In some embodiments, provided herein are methods of selecting a subject for treatment, the methods including: (a) contacting a tumor tissue sample from a subject with a binding reagent capable of specifically binding PD-L; and (b) detecting the presence of the bound binding reagent in or on cells of the tumor tissue sample, optionally wherein the cells are tumor cells or tumor infiltrating immune cells; and (c) if the tumor sample comprises a detectable level of cells surface positive for PD-L1, selecting the subject for treatment with an immunomodulatory protein comprising a variant CD80 polypeptide, said variant CD80 polypeptide comprising one or more amino acid modifications at one or more positions in the IgV domain or IgC domain or the specific binding fragment thereof of an unmodified CD80 or specific binding fragment thereof, wherein the variant CD80 polypeptide exhibits increased binding affinity to the ectodomain of PD-L1 compared to the binding affinity of the unmodified CD80 for the ectodomain of PD-L1.

In some embodiments, the methods further include contacting the tumor tissue sample with a binding reagent capable of specifically binding CD28, wherein the subject is selected if the tumor tissue sample further comprises a detectable level of tumor infiltrating lymphocytes positive for CD28, optionally wherein the lymphocytes are T cells, optionally CD8+ T cells.

In some embodiments, the tumor tissue sample contains tumor infiltrating immune cells, tumor cells, stromal cells, or any combination thereof.

In some embodiments, the binding reagent is an antibody or antigen-binding fragment, protein ligand or binding partner, an aptamer, an affimer, a peptide or a hapten. In some embodiments, the binding reagent is an anti-PD-L1 antibody or antigen-binding fragment. In some embodiments, the binding reagent is a variant CD80 polypeptide provided herein. In some embodiments, the variant CD80 polypeptide comprises the IgV domain or a specific binding fragment thereof. In some embodiments, the IgV domain or specific binding fragment thereof is the only CD80 portion of the binding reagent.

In some embodiments, the variant CD80 polypeptide exhibits increased affinity for binding to PD-L1 compared to the wildtype or unmodified CD80 polypeptide.

In some embodiments, the binding reagent is linked, directly or indirectly, to a moiety that is a detectable moiety or a moiety capable of detection. In some embodiments, the moiety is an Fc region. In some embodiments, the Fc region is non-human, optionally is mouse or rabbit.

In some embodiments, detecting the presence of bound binding reagent is by immunohistochemistry, pseudo-immunohistochemistry, immunofluorescence, flow cytometry, ELISA or immunoblotting.

In some embodiments, the methods further include administering the immunomodulatory protein to the subject. In some embodiments, the subject is a human subject.

In some embodiments, the immunomodulatory protein is a multimer comprising a first variant CD80 polypeptide linked to a first multimerization domain and a second variant CD80 polypeptide linked to a second multimerization domain, wherein the first and second multimerization domain interact to form a multimer comprising the first and second variant CD80 polypeptide. In some embodiments, the multimer is a dimer. In some embodiments, the first variant CD80 polypeptide and the second variant CD80 polypeptide are the same.

In some embodiments, the multimerization domain is or comprises an Fc region, optionally a variant Fc region containing one or more amino acid substitutions compared to a wildtype Fc region, wherein the Fc region exhibits one or more effector function that is reduced compared to the wildtype Fc region, optionally where the wildtype Fc is human IgG1.

In some of such embodiments, the CD80 polypeptide contains one or more amino acid modifications in an unmodified CD80 or specific binding fragment thereof, corresponding to position(s) 7, 12, 13, 15, 16, 18, 20, 22, 23, 24, 25, 26, 27, 28, 29, 30, 31, 33, 34, 35, 36, 37, 38, 41, 42, 43, 44, 46, 47, 48, 51, 53, 54, 55, 57, 58, 61, 62, 63, 65, 67, 68, 69, 70, 71, 72, 73, 74, 76, 77, 78, 79, 81, 82, 83, 84, 85, 86, 87, 88, 89, 90, 91, 92, 93, 94, 95, and/or 97, with reference to numbering of SEQ ID NO: 2. In some of such embodiments, the CD80 polypeptide contains one or more amino acid modifications in an unmodified CD80 or specific binding fragment thereof, selected from among E7D, A12V, T13A, T13R, S15P, C16R, H18L, H18Y, V20A, V20I, V22A, V22D, V22I, V22L, E23D, E23G, E24D, L25S, A26E, A26P, A26S, A26T, Q27H, T28Y, R29H, 130T, 130V, Y31H, Y31S, Q33E, Q33H, Q33K, Q33L, Q33R, K34E, E35D, K36R, K37E, M38T, M38V, T41A, T41S, M421, M42V, M431, M43L, M43T, M43V, S44P, D46E, D46V, M47I, M47L, M47T, M47V, N48D, N48H, N48K, N48R, N48S, N48T, P51A, Y53F, Y53H, K54R, N55D, N55I, T57I, 158V, I61N, I61V, T62A, T62N, T62S, N63D, L65P, I67L, I67T, V68A, V68L, V68M, I69F, L70M, L70P, L70Q, L70R, A71D, A71G, L72P, L72V, R73S, P74S, D76H, E77A, G78A, T79A, T79I, T79L, T79P, E81G, E81K, C82R, V83A, V83I, V84A, V84I, L85E, L85M, L85Q, K86E, K86M, Y87H, Y87N, Y87Q, E88D, E88G, K89E, K89N, D90G, D90N, A91T, A91V, F92L, F92S, F92V, F92Y, K93E, K93R, K93T, R94Q, R94W, E95D, E95K, E95V, L97M, L97Q, and L97R, wherein the position(s) of the amino acid substitution(s) correspond(s) to the positions of CD80 set forth in SEQ ID NO: 2.

In some embodiments, the variant CD80 polypeptide retains binding to CD28. In some embodiments, the variant CD80 polypeptide retains at least or at least about 2%, 3%, 4%, 5%, 6%, 7%, 8,%, 9%, 10%, 12%, 15%, 20%, 25%, 30%, 35% 40%, 50%, 55%, 60%, 65%, 70% 75%, 80%, 85%, 90%, or 95% of the affinity to the ectodomain of CD28, compared to the binding affinity of the unmodified CD80 polypeptide for the ectodomain of CD28. In some embodiments, the variant CD80 polypeptide exhibits increased binding affinity to the ectodomain of CD28 compared to the binding affinity of the unmodified CD80 for the ectodomain of CD28. In some of such embodiments, the increased affinity to the ectodomain of CD28 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to binding affinity of the unmodified CD80 for the ectodomain of CD28.

In some embodiments, increasing the immune response treats a disease or condition in the subject. In some embodiments the disease or condition is a tumor or cancer. In some embodiments, the disease or condition is selected from melanoma, lung cancer, bladder cancer, a hematological malignancy, liver cancer, brain cancer, renal cancer, breast cancer, pancreatic cancer, colorectal cancer, spleen cancer, prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer.

In some embodiments, provided herein is a method of detecting a CD80 binding partner in a biological sample, the method comprising: (a) contacting a biological sample with a binding reagent comprising any of the variant CD80 polypeptides provided herein; and (b) detecting the presence of the bound binding reagent in or on cells of the biological sample. In some embodiments, the binding partner is PD-L1, CD28, CTLA-4 or combinations thereof.

In some embodiments, the variant CD80 polypeptide comprises one or more amino acid modifications at one or more positions in the IgV domain or IgC domain or the specific binding fragment thereof of an unmodified CD80 or specific binding fragment thereof, wherein the variant CD80 polypeptide exhibits increased binding affinity to the ectodomain of PD-L1 compared to the binding affinity of the unmodified CD80 for the ectodomain of PD-L1.

In some embodiments, the biological sample is or comprises a body fluid, cell or tissue sample, such as body fluid that is serum, plasma or urine or a tissue sample that is a tumor tissue sample. In some embodiments, the tumor tissue sample contains tumor infiltrating immune cells, tumor cells, stromal cells, or any combination thereof.

In some embodiments, the variant CD80 polypeptide comprises the IgV domain or a specific binding fragment thereof. In some embodiments, the IgV domain or specific binding fragment thereof is the only CD80 portion of the binding reagent.

In some embodiments, the binding reagent is linked, directly or indirectly, to a label that is a detectable moiety or to a moiety capable of detection. In some embodiments, the moiety is an Fc region, that is optionally non-human, such as a mouse or rabbit Fc region. In some embodiments, detecting the presence of bound binding reagent is by immunohistochemistry, pseudo-immunohistochemistry, immunofluorescence, flow cytometry, ELISA or immunoblotting.

BRIEF DESCRIPTION OF THE DRAWINGS

FIG. 1A depicts soluble molecules, including: (1) a variant IgSF domain (vIgD) fused to an Fc chain; (2) a stack molecule containing a first variant IgSF domain (first vIgD) and a second IgSF domain, such as a second variant IgSF domain (second vIgD); (3) a tumor targeting IgSF molecule containing a first variant IgSF domain (vIgD) and an IgSF domain that targets to a tumor antigen, such as an NKP30 IgSF domain; and (4) a variant IgSF domain (vIgD) linked to an antibody (V-mAb). FIG. 1B depicts a transmembrane immunomodulatory protein (TIP) containing a variant IgSF domain (vIgD) expressed on the surface of a cell. In an exemplary embodiment, the cognate binding partner of the transmembrane bound vIgD is an inhibitory receptor (e.g., CTLA-4), and the TIP containing the vIgD (e.g., CD80 vIgD) antagonizes or blocks the negative signaling of the inhibitory receptor, thereby resulting in an activated T cell or effector T cell. In some cases, if clustering of the inhibitory receptor (CTLA-4) is proximal to an activating receptor (e.g., CD28) then agonizing activity by the TIP may be realized. FIG. 1C depicts a secreted immunomodulatory protein (SIP) in which a variant IgSF domain (vIgD) is secreted from a cell, such as a first T cell (e.g., CAR T cell). In an exemplary embodiment, the cognate binding partner of the secreted vIgD is an inhibitory receptor (e.g., CTLA-4), which can be expressed by the first cell (e.g., T cell, such as a CAR T cell) and/or on a second cell (e.g., T cell; either endogenous or engineered, such as a CAR T cell). Upon binding of the SIP with its cognate binding partner, the SIP antagonizes or blocks the negative signaling via the inhibitory receptor, thereby resulting in an activated T cell or effector T cell. In all cases, the vIgD can be a V-domain (IgV) only, the combination of the V-domain (IgV) and C-domain (IgC), including the entire extracellular domain (ECD), or any combination of Ig domains of the IgSF superfamily member.

FIG. 8A shows various configurations in which a variant IgSF domain is linked, directly or indirectly, to the N- and/or C-terminus of the light chain of an antibody. FIG. 8B shows various configurations in which a variant IgSF domain is linked, directly or indirectly, to the N- and/or C-terminus of the heavy chain of an antibody. FIG. 8C depicts the results V-Mab configurations when a light chain of FIG. 8A and a heavy chain of FIG. 8B are co-expressed in a cell.

DETAILED DESCRIPTION

Figure 1A:
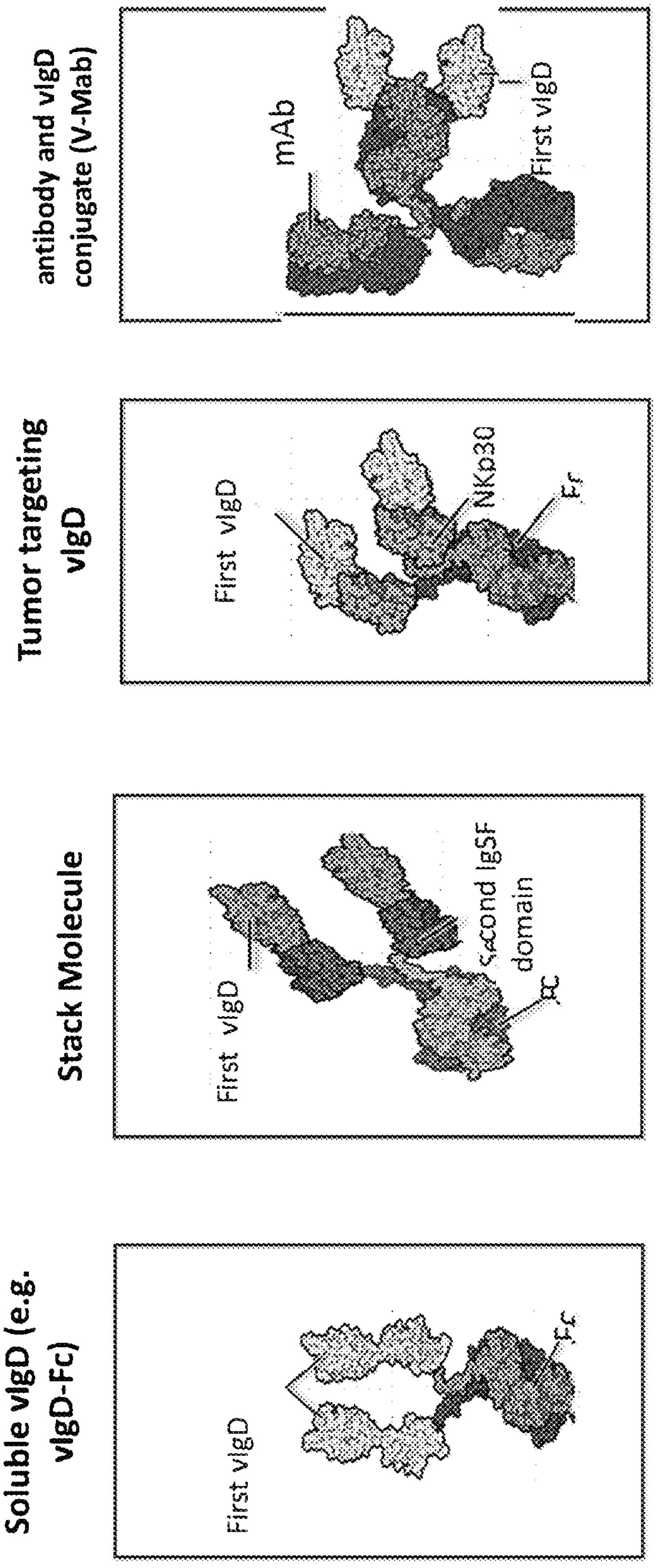
FIG. 1A-1C depicts various formats of the provided variant IgSF domain molecules.

Provided herein are immunomodulatory proteins that are or contain variants or mutants of CD80 and specific binding fragments thereof that exhibit altered binding activity or affinity to at least one target ligand cognate binding partner (also called counter-structure ligand protein). In some embodiments, the variant CD80 polypeptides contain one or more amino acid modifications (e.g., amino acid substitutions, deletions, or additions) compared to an unmodified or wild-type CD80 polypeptide. In some embodiments, the variant CD80 polypeptides contain one or more amino acid modifications (e.g., substitutions) compared to an unmodified or wild-type CD80 polypeptide. In some embodiments, the one or more amino acid substitutions are in an IgSF domain (e.g., IgV) of an unmodified or wild-type CD80 polypeptide.

In some embodiments, the altered binding activity, such as binding affinity and/or binding selectivity, e.g., increased or decreased binding affinity or selectivity, is for at least one binding partner protein CD28, PD-L1, or CTLA-4. In some embodiments, the variant CD80 polypeptides exhibit altered, such as increased or decreased, binding activity or affinity to one or more of CD28, PD-L1, or CTLA-4 compared to the unmodified or wild-type CD80 not containing the one or more modifications.

In some embodiments, the variant CD80 polypeptides exhibit increased binding affinity to CTLA-4 and/or PD-L1 compared to the unmodified or wild-type CD80 not containing the one or more modifications. In some embodiments, the variant CD80 polypeptides exhibit decreased binding affinity to CD28 compared to the unmodified or wild-type CD80 not containing the one or more modifications. In some embodiments, the variant CD80 polypeptides exhibit increased binding affinity to one or both of CTLA-4 and PD-L1, and decreased binding affinity to CD28 compared to the unmodified or wild-type CD80 not containing the one or more modifications.

In some embodiments, the variant CD80 polypeptides provided herein exhibit increased selectivity for binding to CTLA-4 versus CD28 compared to the selectivity of the unmodified or wild-type CD80 not containing the one more modifications for binding to CTLA-4 versus CD28. The increased selectivity can be characterized as a greater ratio of binding, e.g., binding affinity, of the variant CD80 polypeptide for CTLA-4 versus CD28 compared to the ratio of binding, e.g., binding affinity, of the unmodified or wild-type CD80 for binding of CTLA-4 versus CD28. In some embodiments, the ratio is increased greater than or greater than about 1.2-fold, 1.5-fold, 2.0-fold, 3.0-fold, 4.0-fold, 5.0-fold, 6.0-fold, 7.0-fold, 8.0-fold, 9.0-fold, 10.0-fold, 15.0-fold, 20-fold, 30-fold, 40-fold, 50-fold, 100-fold or more.

In some embodiments, the variant CD80 polypeptides provided herein exhibit increased selectivity for binding to PD-L1 versus CD28 compared to the selectivity of the unmodified or wild-type CD80 not containing the one more modifications for binding to PD-L1 versus CD28. The increased selectivity can be characterized as a greater ratio of binding, e.g., binding affinity, of the variant CD80 polypeptide for PD-L1 versus CD28 compared to the ratio of binding, e.g., binding affinity, of the unmodified or wild-type CD80 for binding of PD-L1 versus CD28. In some embodiments, the ratio is increased greater than or greater than about 1.2-fold, 1.5-fold, 2.0-fold, 3.0-fold, 4.0-fold, 5.0-fold, 6.0-fold, 7.0-fold, 8.0-fold, 9.0-fold, 10.0-fold, 15.0-fold, 20-fold, 30-fold, 40-fold, 50-fold, 100-fold or more.

In some embodiments, the immunomodulatory proteins are soluble. In some embodiments, the immunomodulatory proteins are transmembrane immunomodulatory proteins capable of being expressed on the surface of cells. In some embodiments, the immunomodulatory proteins are secretable immunomodulatory proteins capable of being secreted from a cell in which it is expressed. In some embodiments, also provided herein are one or more other immunomodulatory proteins that are conjugates or fusions containing a variant CD80 polypeptide provided herein and one or more other moiety or polypeptide. In some aspects, provided are engineered cells containing the transmembrane immunomodulatory proteins or secretable immunomodulatory proteins. In some aspects, provided are infectious agents capable of delivering for expression the transmembrane immunomodulatory proteins or secretable immunomodulatory proteins into a cell in which the infectious agent infects. In some embodiments, also provided herein are one or more other immunomodulatory proteins that are conjugates or fusions containing a variant CD80 polypeptide provided herein and one or more other moiety or polypeptide.

In some embodiments, the variant CD80 polypeptides and immunomodulatory proteins modulate an immunological immune response, such as increase or decrease an immune response. In some embodiments, the variant CD80 polypeptides and immunomodulatory proteins provided herein can be used for the treatment of diseases or conditions that are associated with a dysregulated immune response.

In some embodiments, the provided variant CD80 polypeptides modulate T cell activation, expansion, differentiation, and survival via interactions with costimulatory signaling molecules. In general, antigen specific T-cell activation generally requires two distinct signals. The first signal is provided by the interaction of the T-cell receptor (TCR) with major histocompatibility complex (MHC) associated antigens present on antigen presenting cells (APCs). The second signal is costimulatory, e.g., a CD28 costimulatory signal, to TCR engagement and necessary to avoid T-cell apoptosis or anergy.

In some embodiments, under normal physiological conditions, the T cell-mediated immune response is initiated by antigen recognition by the T cell receptor (TCR) and is regulated by a balance of co-stimulatory and inhibitory signals (e.g., immune checkpoint proteins). The immune system relies on immune checkpoints to prevent autoimmunity (i.e., self-tolerance) and to protect tissues from excessive damage during an immune response, for example during an attack against a pathogenic infection. In some cases, however, these immunomodulatory proteins can be dysregulated in diseases and conditions, including tumors, as a mechanism for evading the immune system.

In some embodiments, among known T-cell costimulatory receptors is CD28, which is the T-cell costimulatory receptor for the ligands B7-1 (CD80) and B7-2 (CD86) both of which are present on APCs. These same ligands can also bind to the inhibitory T-cell receptor CTLA4 (cytotoxic T-lymphocyteassociated protein 4) with greater affinity than for CD28; the binding to CTLA4 acts to down-modulate the immune response.

In some embodiments, CD80 is able to bind to programmed death ligand 1 (PD-L1). CD80 has similar affinity to PD-L1 as to CD28. PD-L1 is one of two ligands for the inhibitory immune receptor, programmed death 1 (PD-1). The interaction of PD-L1 with PD-1 negatively regulates immune activity by promoting T cell inactivation and down-modulating T cell activity. PD-1 expression on T cells may be induced after T cells have been activated as a strategy to prevent over activity of T cells. Many tumor cells express PD-L1 on their surface, potentially leading to PD-1/PD-L1 interactions and the inhibition of T cell responses against the tumor. The binding of CD80 to PD-L1 can block the interaction between PD-L1 and PD-1, and thereby prevent inhibition of T cell responses, e.g., at the site of a tumor, and effectively potentiate or enhance the immune response. At the same time, however, CD80 might also be available to bind to CD28 or CTLA4 receptors, and be involved in inducing or inhibiting T cell responses. Thus, in some cases, interactions of CD80 with PD-L1, CD28, and CTLA-4 can yield overlapping and complementary effects. In some embodiments, CD28 and PD-L1 may play complementary roles in modeling an immune response.

Figure 2:
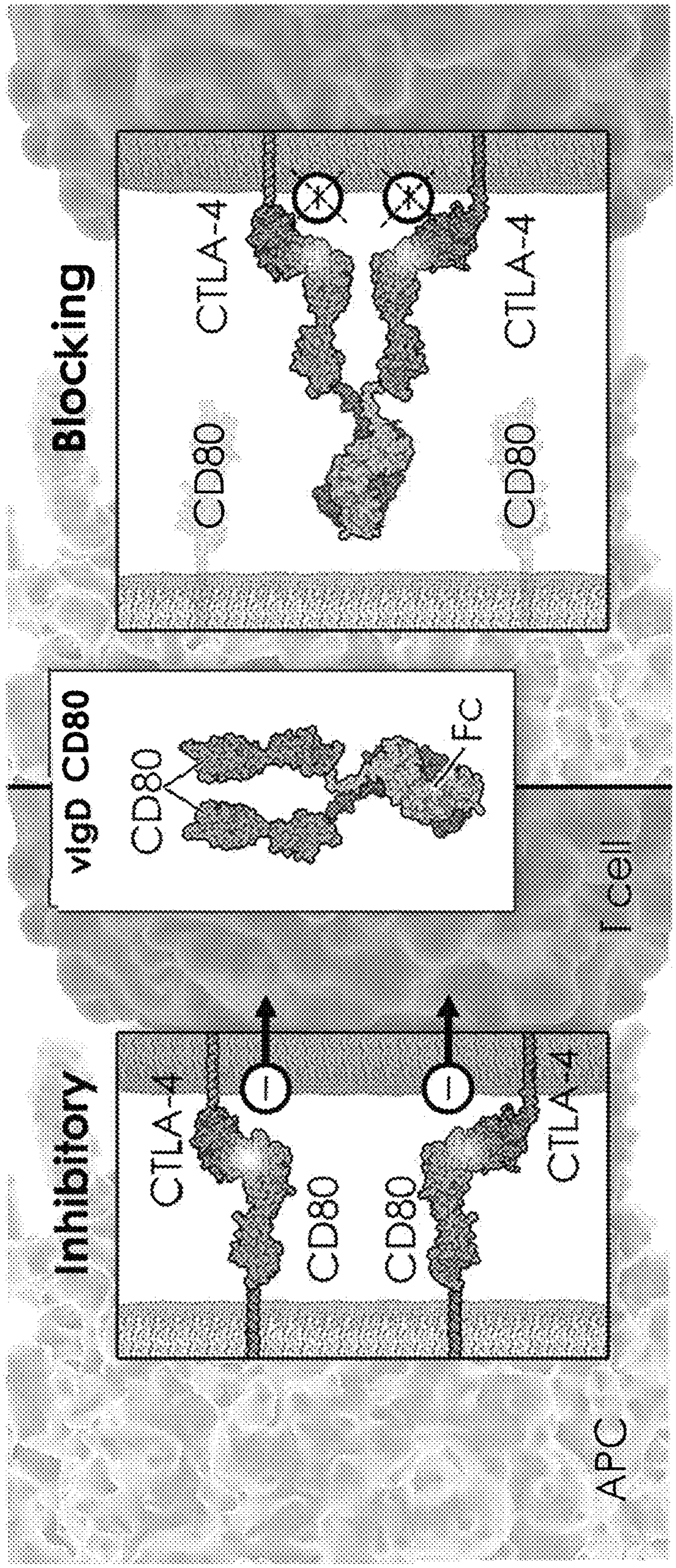
FIG. 2 depicts an exemplary schematic of the activity of a variant IgSF domain (vIgD) fused to an Fc (vIgD-Fc) in which the vIgD is a variant of an IgSF domain of CD80. As shown, a soluble vIgD of CD80 interacts with its cognate binding partners to block interaction of CD80 with CTLA-4, thereby blocking the CTLA-4 inhibitory receptor, and, in some cases, allowing the T cell to differentiate into an effector phenotype.
Figure 3A:
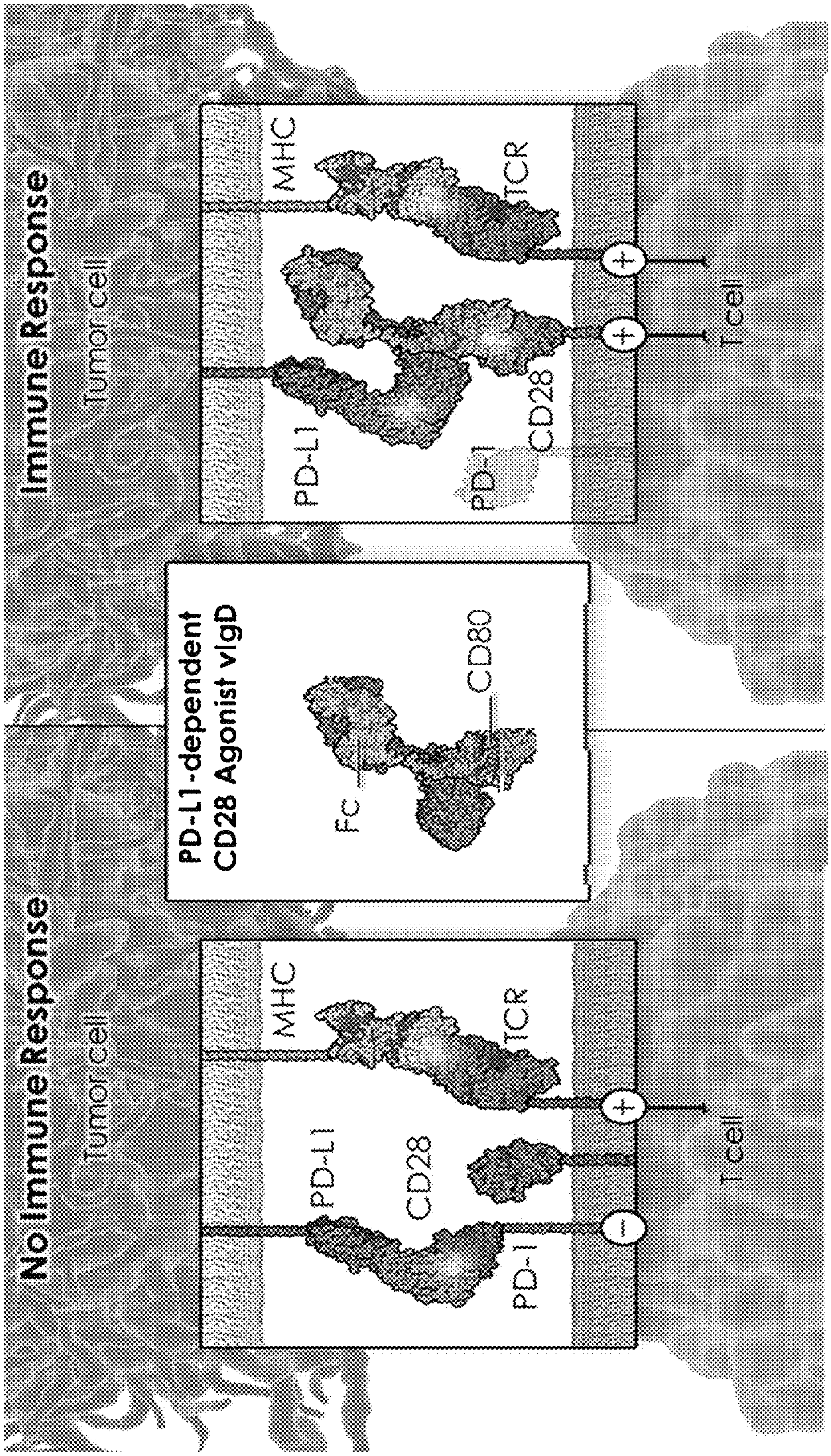
FIG. 3A depicts an exemplary schematic of the activity of a variant IgSF domain (vIgD)-conjugated to an Fc in which the CD80-Fc effects PD-L1-dependent CD28 agonist activity. As shown, binding of the CD80-Fc to PD-L1, expressed on the surface of a tumor cell, can prevent the association of the PD-L1 on the tumor cell and the inhibitory PD-1 receptor, expressed on the surface of a T cell. In addition, the CD80-Fc is available to bind the costimulatory CD28 receptor on the surfaces of a T cell, thereby localizing the T cell to the tumor while promoting T cell activation via CD28 costimulation of TCR signal.
Figure 3B:
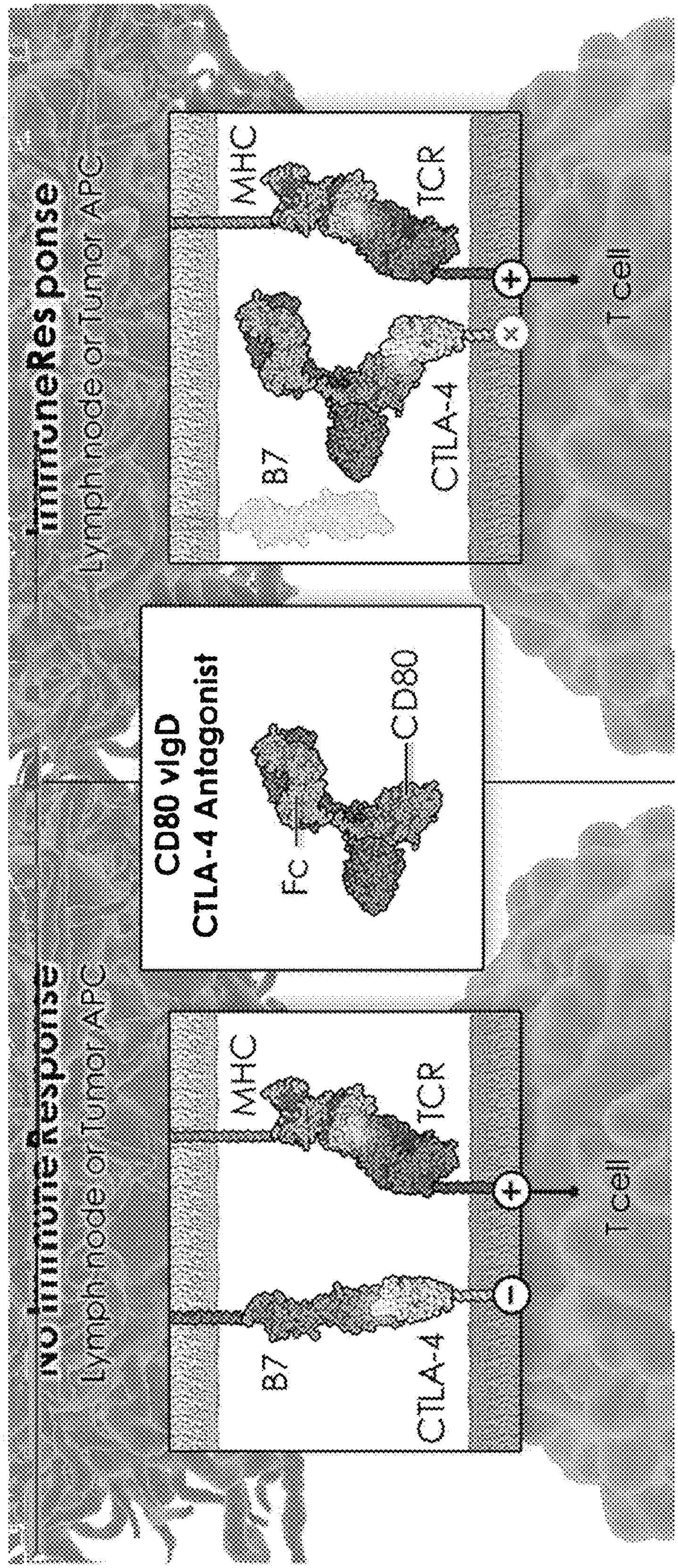
FIG. 3B depicts an exemplary schematic of the activity of a CD80 variant IgSF domain (vIgD), conjugated to an Fc, in which the CD80-Fc blocks CTLA-4 inhibitory activity. As shown, binding of the CD80 vIgD-Fc to CTLA-4, expressed on the surface of T cells (e.g., $T_{reg}$ and $T_{eff}$ cells), thereby antagonizing binding of CTLA-4 to its cognate binding partners CD80 (B7-1) and CD86 (B7-2), indicated as B7, and blocking CTLA-4 inhibitory signaling, reducing the TCR signaling threshold, and promoting T cell activation.
Figure 4:
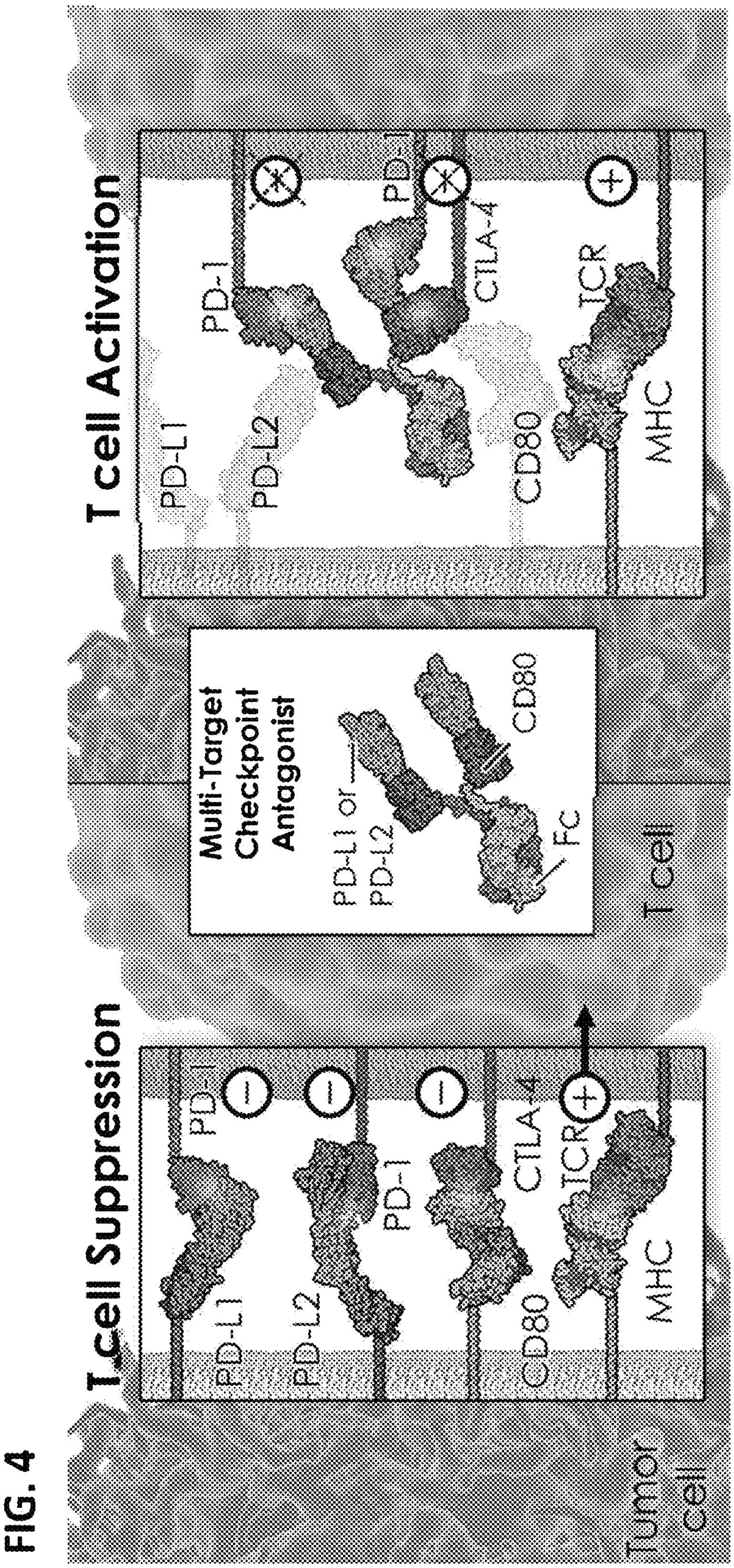
FIG. 4 depicts an exemplary schematic of a stack molecule that is a multi-target checkpoint antagonist containing a first variant IgSF domain (first vIgD) that is a PD-L1 or PD-L2 vIgD and a second IgSF domain (e.g., a second vIgD) that binds to a second inhibitory receptor. In the exemplary schematic, the second IgSF domain (e.g., second vIgD) is a CD80 vIgD. As shown, the first vIgD and second vIgD interact with their cognate binding partners to block interactions of PD-L1 or PD-L2 with PD-1 and CD80 with CTLA-4 inhibitory receptors, respectively.
Figure 5:
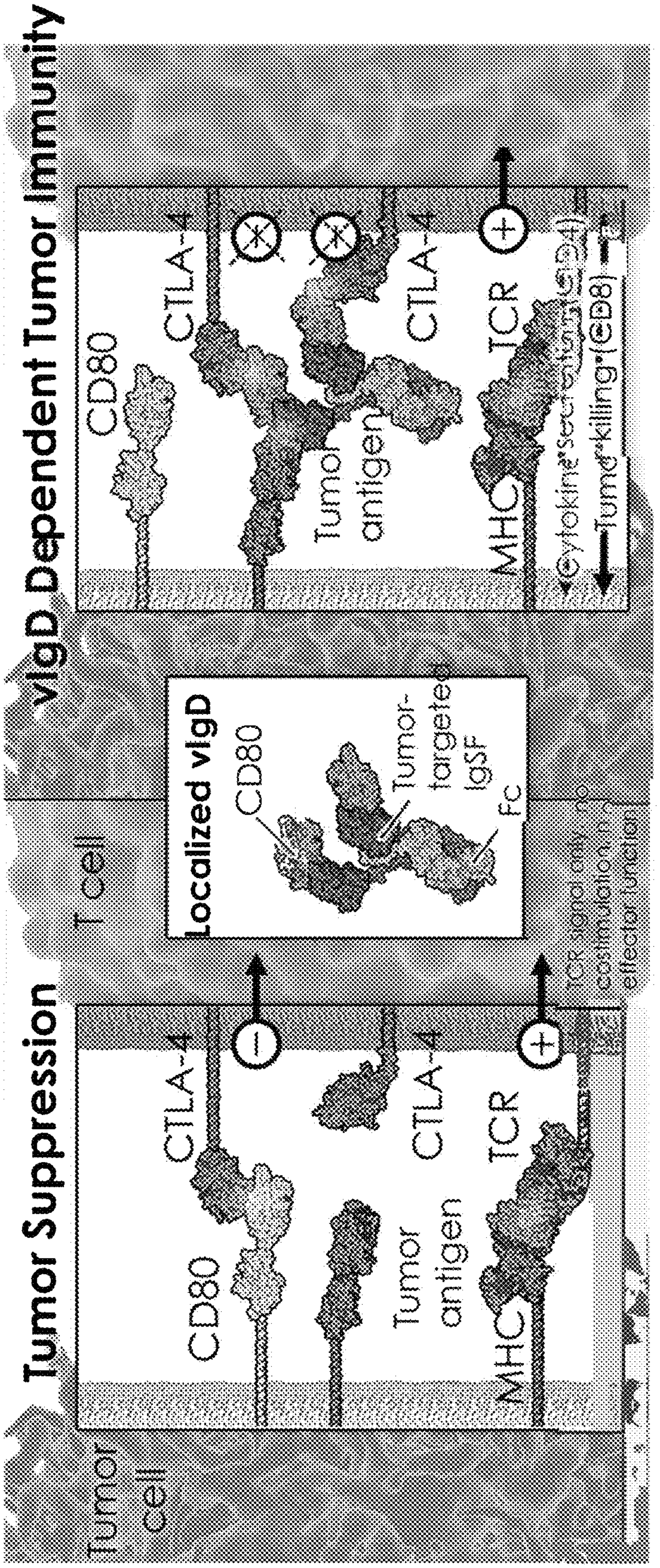
FIG. 5 depicts an exemplary schematic of a stack molecule for localizing the variant IgSF (vIgD) to a tumor cell. In this format, the stack molecule contains a first variant IgSF domain (first vIgD) and a second IgSF domain (e.g., a second vIgD) in which the second IgSF domain (e.g., a second vIgD) is a tumor-targeted IgSF domain that binds to a tumor antigen. An exemplary tumor-targeted IgSF domain is an IgSF domain of NKp30, which binds to the tumor antigen B7-H6. In this depiction, the first variant IgSF domain (vIgD) is a variant of an IgSF domain of CD80. As shown, binding of tumor-targeted IgSF domain to the surface of the tumor cell localizes the first variant IgSF domain on the tumor cell surface where it can interact with one or more of its cognate binding partners expressed on the surface of an adjacent immune cell (e.g., T cell) to antagonize the cognate inhibitory receptor CTLA-4.
Figure 7:
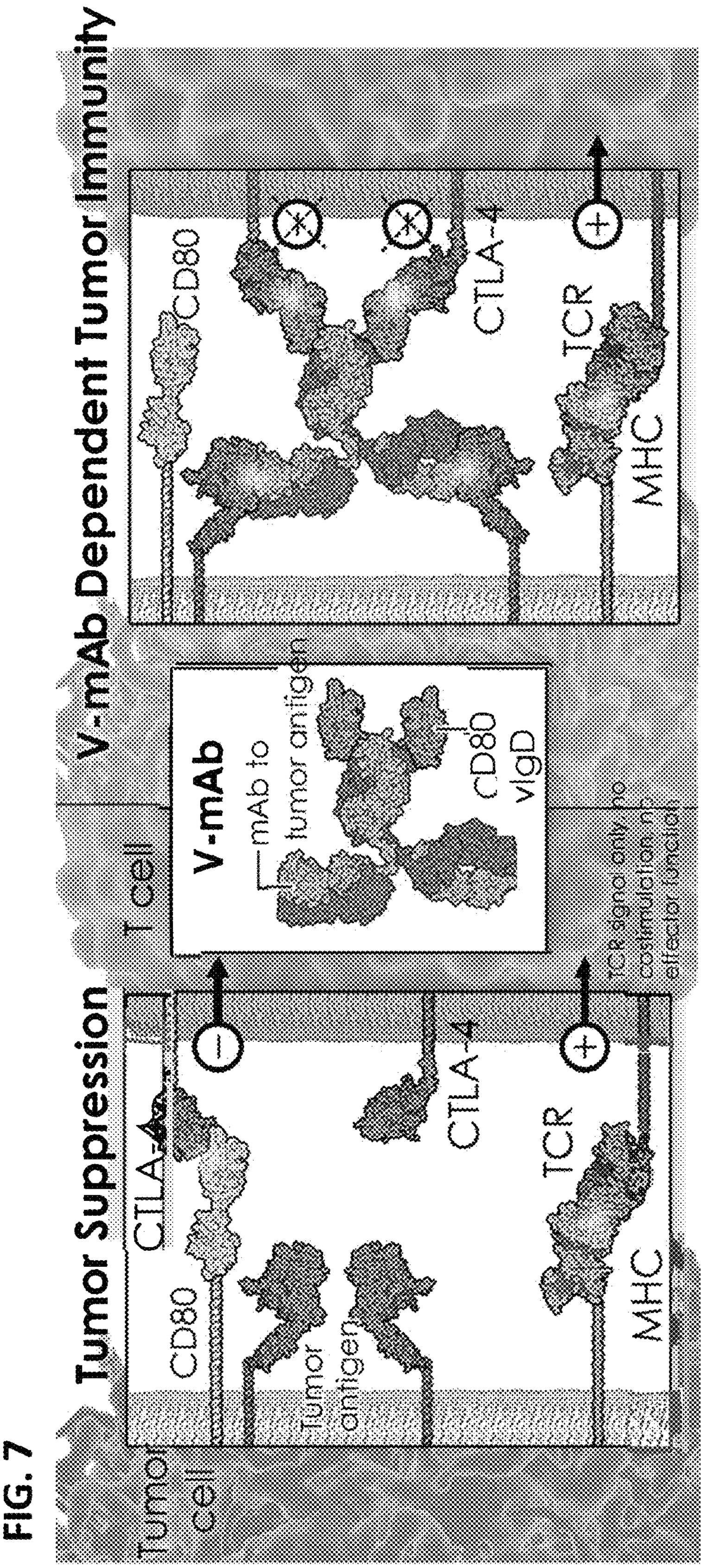
FIG. 7 depicts an exemplary schematic of the activity of a variant IgSF domain (vIgD)-conjugated to an antibody (V-Mab) in which the antibody (e.g., anti-HER2 antibody) binds to an antigen on the surface of the tumor cell to localize the vIgD to the cell. As shown, binding of the antibody to the surface of the tumor cell localizes the vIgD on the tumor cell surface where it can interact with one or more of its cognate binding partners expressed on the surface of an adjacent immune cell (e.g., T cell) to agonize or antagonize receptor signaling. In an exemplary embodiment as shown, the variant IgSF domain (vIgD) is a variant of an IgSF domain of CD80 that binds, such as has increased affinity for, the inhibitory receptor CTLA-4. Binding of the CD80 vIgD to the CTLA-4 inhibitory receptor antagonizes or blocks the negative signaling of the inhibitory receptor, thereby resulting in an activated T cell or effector T cell. In some cases, if clustering of the inhibitory receptor (CTLA-4) is proximal to an activating receptor (e.g., CD28) then agonizing of the inhibitory receptor activity by the TIP may be realized.

In some embodiments, the provided variant CD80 polypeptides or immunomodulatory proteins modulate (e.g., increase or decrease) immunological activity induced or associated with the inhibitory receptor CTLA-4, the PD-L1/PD-1 negative regulatory complex and/or the costimulatory receptor CD28. For example, in some embodiments, the provided CD80 polypeptides, e.g., soluble forms of the variant CD80 polypeptides provided herein, bind the CTLA-4 inhibitory receptor, blocking its interaction with CD80, expressed on an APC, thereby preventing the negative regulatory signaling of the CD80-bound CTLA-4 receptor as depicted in in FIG. 2. In some embodiments, the provided CD80 polypeptides, e.g., soluble forms of the variant CD80 polypeptides provided herein, are capable of binding the PD-L1 on a tumor cell or APC, thereby blocking the interaction of PD-L1 and the PD-1 inhibitory receptor, thereby preventing the negative regulatory signaling that would have otherwise resulted from the PD-L1/PD-1 interaction. In some embodiments, the provided CD80 polypeptides, e.g., soluble forms of the variant CD80 polypeptides provided herein, can block the PD-L1/PD-1 interaction while, binding and co-stimulating a CD28 receptor on a localized T cell, thereby promoting an immune response (FIG. 3A). In some embodiments, the provided CD80 polypeptides, e.g., soluble forms of the variant CD80 polypeptides provided herein, can antagonize B7/CTLA-4 binding, preventing CTLA-4 inhibitory signaling, reducing the TCR signaling threshold, thereby promoting T cell activation and immune response (FIG. 3B). In some embodiments, the provided CD80 variant polypeptides can be stacked or conjugated with other immunomodulatory polypeptides to further modulate immune activity (FIG. 4) or stacked or conjugated with targeting molecules to localize immune activity (FIG. 5 and FIG. 7). Thus, in some embodiments, the provided polypeptides overcome these constraints by providing variants CD80 with independent binding affinities to both CTLA-4 and/or PD-L1, and, in some cases, CD28, thereby agonizing or antagonizing the complementary effects of costimulation by receptors. Methods of making and using these variants CD80 are also provided.

Also provided are various formats of the provided variant polypeptides. As shown herein, alternative formats can facilitate manipulation of the immune response, and hence the therapeutic application. The ability to format the variant polypeptides in various configurations to, depending on the context, antagonize or agonize an immune response, offers flexibility in therapeutic applications based on the same increased binding and activity of a variant CD80 for binding partners. As an example, tethering variant CD80 proteins to a surface can deliver a localized costimulatory signal, while, in other cases, presenting CD80 in a non-localized soluble form confers antagonistic activity. For example, delivery of enhanced CD80 protein in soluble formats with increased affinity for CTLA-4 and/or PD-L1 can antagonize signaling of an inhibitory receptor, such as block an inhibitory signal in the cell that may occur to decrease response to an activating stimulus, e.g., CD3 and/or CD28 costimulatory signal or a mitogenic signal. In some cases, the result of this can be to increase the immune response.

Additionally, certain formats, in some cases, also can mediate CD28 agonism. In some cases, CD28 agonism is mediated by certain variant CD80 polypeptides exhibiting increased binding to PD-L1 to thereby facilitate tethering or crosslinking of the variant CD80 molecule to a surface at the immune synapse for interaction with CD28, thereby facilitating T cell activation by providing a costimulatory signal. This activity, designated herein as PD-L1-dependent CD28 costimulation, is due, in some aspects, to the ability of a variant CD80 polypeptide to bind both PD-L1 and CD80 in a non-competitive manner and/or by provision of a dimeric format of a variant CD80 polypeptide (see e.g. FIG. 3). In some cases, such PD-L1-dependent costimulation does not require an Fc with effector function and can be mediated by an Fc fusion protein containing an effector-less or inert Fc molecule. In some aspects, tethering or crosslinking also, additionally or alternatively, can be achieved via the Fc receptor when a variant CD80 polypeptide is provided as a fusion protein with a wild-type Fc region of an immunoglobulin that retains or exhibits effector function, designated herein as Fc receptor-dependent CD28 costimulation. In some aspects, crosslinking the Fc receptor can initiate antibody-dependent cell cytotoxicity (ADCC)-mediated effector functions, and thereby effect depletion of target cells expressing the cognate binding partner, such as CTLA-4-expressing cells (e.g. CTLA-4-expressing T regulatory cells) or PD-L1-expressing cells (e.g. PD-Llhitumors).

Enhancement or suppression of the activity of these receptors has clinical significance for treatment of inflammatory and autoimmune disorders, cancer, and viral infections. In some cases, however, therapies to intervene and alter the costimulatory effects of both receptors are constrained by the spatial orientation requirements as well as size limitations imposed by the confines of the immunological synapse. In some aspects, existing therapeutic drugs, including antibody drugs, may not be able to interact simultaneously with the multiple target proteins involved in modulating these interactions. In addition, in some cases, existing therapeutic drugs may only have the ability to antagonize, but not agonize, an immune response. Additionally, pharmacokinetic differences between drugs that independently target one or the other of these two receptors can create difficulties in properly maintaining a desired blood concentration of such drug combinations throughout the course of treatment. The provided variant CD80 polypeptides and immunomodulatory proteins, and other formats as described, address such problems.

All publications, including patents, patent applications scientific articles and databases, mentioned in this specification are herein incorporated by reference in their entirety for all purposes to the same extent as if each individual publication, including patent, patent application, scientific article or database, were specifically and individually indicated to be incorporated by reference. If a definition set forth herein is contrary to or otherwise inconsistent with a definition set forth in the patents, applications, published applications and other publications that are herein incorporated by reference, the definition set forth herein prevails over the definition that is incorporated herein by reference.

The section headings used herein are for organizational purposes only and are not to be construed as limiting the subject matter described.

I. Definitions

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

The terms used throughout this specification are defined as follows unless otherwise limited in specific instances. As used in the specification and the appended claims, the singular forms "a," "an," and "the" include plural referents unless the context clearly dictates otherwise. Unless defined otherwise, all technical and scientific terms, acronyms, and abbreviations used herein have the same meaning as commonly understood by one of ordinary skill in the art to which the invention pertains. Unless indicated otherwise, abbreviations and symbols for chemical and biochemical names are per IUPAC-IUB nomenclature. Unless indicated otherwise, all numerical ranges are inclusive of the values defining the range as well as all integer values in-between.

The term "affinity modified" as used in the context of an immunoglobulin superfamily domain, means a mammalian immunoglobulin superfamily (IgSF) domain having an altered amino acid sequence (relative to the corresponding wild-type parental or unmodified IgSF domain) such that it has an increased or decreased binding affinity or avidity to at least one of its cognate binding partners (alternatively "counter-structures") compared to the parental wild-type or unmodified (i.e., non-affinity modified) IgSF control domain. Included in this context is an affinity modified CD80 IgSF domain. In some embodiments, the affinity-modified IgSF domain can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid differences, such as amino acid substitutions, in a wildtype or unmodified IgSF domain. An increase or decrease in binding affinity or avidity can be determined using well known binding assays such as flow cytometry. Larsen et al., American Journal of Transplantation, Vol 5: 443-453 (2005). See also, Linsley et al., Immunity, Vol 1(9: 793-801 (1994). An increase in a protein's binding affinity or avidity to its cognate binding partner(s) is to a value at least 10% greater than that of the wild-type IgSF domain control and in some embodiments, at least 20%, 30%, 40%, 50%, 100%, 200%, 300%, 500%, 1000%, 5000%, or 10000% greater than that of the wild-type IgSF domain control value. A decrease in a protein's binding affinity or avidity to at least one of its cognate binding partner is to a value no greater than 90% of the control but no less than 10% of the wild-type IgSF domain control value, and in some embodiments no greater than 80%, 70% 60%, 50%, 40%, 30%, or 20% but no less than 10% of the wild-type IgSF domain control value. An affinity-modified protein is altered in primary amino acid sequence by substitution, addition, or deletion of amino acid residues. The term "affinity modified IgSF domain" is not to be construed as imposing any condition for any particular starting composition or method by which the affinity-modified IgSF domain was created. Thus, the affinity modified IgSF domains of the present invention are not limited to wild type IgSF domains that are then transformed to an affinity modified IgSF domain by any particular process of affinity modification. An affinity modified IgSF domain polypeptide can, for example, be generated starting from wild type mammalian IgSF domain sequence information, then modeled in silico for binding to its cognate binding partner, and finally recombinantly or chemically synthesized to yield the affinity modified IgSF domain composition of matter. In but one alternative example, an affinity modified IgSF domain can be created by site-directed mutagenesis of a wild-type IgSF domain. Thus, affinity modified IgSF domain denotes a product and not necessarily a product produced by any given process. A variety of techniques including recombinant methods, chemical synthesis, or combinations thereof, may be employed.

The term "allogeneic" as used herein means a cell or tissue that is removed from one organism and then infused or adoptively transferred into a genetically dissimilar organism of the same species. In some embodiments of the invention, the species is murine or human.

The term "autologous" as used herein means a cell or tissue that is removed from the same organism to which it is later infused or adoptively transferred. An autologous cell or tissue can be altered by, for example, recombinant DNA methodologies, such that it is no longer genetically identical to the native cell or native tissue which is removed from the organism. For example, a native autologous T-cell can be genetically engineered by recombinant DNA techniques to become an autologous engineered cell expressing a transmembrane immunomodulatory protein and/or chimeric antigen receptor (CAR), which in some cases involves engineering a T-cell or TIL (tumor infiltrating lymphocyte). The engineered cells are then infused into a patient from whom the native T-cell was isolated. In some embodiments, the organism is human or murine.

The terms "binding affinity," and "binding avidity" as used herein means the specific binding affinity and specific binding avidity, respectively, of a protein for its counter-structure under specific binding conditions. In biochemical kinetics, avidity refers to the accumulated strength of multiple affinities of individual non-covalent binding interactions, such as between CD80 and its counter-structures PD-L1, CD28, and/or CTLA-4. As such, avidity is distinct from affinity, which describes the strength of a single interaction. An increase or attenuation in binding affinity of a variant CD80 containing an affinity modified CD80 IgSF domain to its counter-structure is determined relative to the binding affinity of the unmodified CD80, such as an unmodified CD80 containing the native or wild-type IgSF domain, such as IgV domain. Methods for determining binding affinity or avidity are known in art. See, for example, Larsen et al., American Journal of Transplantation, Vol. 5: 443-453 (2005). In some embodiments, a variant CD80, such as containing an affinity modified IgSF domain, specifically binds to CD28, PD-L1 and/or CTLA-4 measured by flow cytometry with a binding affinity that yields a Mean Fluorescence Intensity (MFI) value at least 10%, 20%, 30%, 40%, 50%, 60%, 70%, 80%, 90%, or 100% greater than an unmodified CD80 control in a binding assay such as described in Example 6.

The term "biological half-life" refers to the amount of time it takes for a substance, such as an immunomodulatory polypeptide containing a variant CD80 polypeptide of the present invention, to lose half of its pharmacologic or physiologic activity or concentration. Biological half-life can be affected by elimination, excretion, degradation (e.g., enzymatic) of the substance, or absorption and concentration in certain organs or tissues of the body. In some embodiments, biological half-life can be assessed by determining the time it takes for the blood plasma concentration of the substance to reach half its steady state level ("plasma half-life"). Conjugates that can be used to derivatize and increase the biological half-life of polypeptides of the invention are known in the art and include, but are not limited to, polyethylene glycol (PEG), hydroxyethyl starch (HES), XTEN (extended recombinant peptides; see, WO2013130683), human serum albumin (HSA), bovine serum albumin (BSA), lipids (acylation), and poly-Pro-Ala-Ser (PAS), polyglutamic acid (glutamylation).

The term "chimeric antigen receptor" or "CAR" as used herein refers to an artificial (i.e., man-made) transmembrane protein expressed on a mammalian cell containing at least an ectodomain, a transmembrane, and an endodomain. Optionally, the CAR protein includes a "spacer" which covalently links the ectodomain to the transmembrane domain. A spacer is often a polypeptide linking the ectodomain to the transmembrane domain via peptide bonds. The CAR is typically expressed on a mammalian lymphocyte. In some embodiments, the CAR is expressed on a mammalian cell such as a T-cell or a tumor infiltrating lymphocyte (TIL). A CAR expressed on a T-cell is referred to herein as a "CAR T-cell" or "CAR-T." In some embodiments the CAR-T is a T helper cell, a cytotoxic T-cell, a natural killer T-cell, a memory T-cell, a regulatory T-cell, or a gamma delta T-cell. When used clinically in, e.g., adoptive cell transfer, a CAR-T with antigen binding specificity to the patient's tumor is typically engineered to express on a native T-cell obtained from the patient. The engineered T-cell expressing the CAR is then infused back into the patient. The CAR-T is thus often an autologous CAR-T although allogeneic CAR-Ts are included within the scope of the invention. The ectodomain of a CAR contains an antigen binding region, such as an antibody or antigen binding fragment thereof (e.g., scFv), that specifically binds under physiological conditions with a target antigen, such as a tumor specific antigen Upon specific binding a biochemical chain of events (i.e., signal transduction) results in modulation of the immunological activity of the CAR-T. Thus, for example, upon specific binding by the antigen binding region of the CAR-T to its target antigen can lead to changes in the immunological activity of the T-cell activity as reflected by changes in cytotoxicity, proliferation or cytokine production. Signal transduction upon CAR-T activation is achieved in some embodiments by the CD3-zeta chain ("CD3-z") which is involved in signal transduction in native mammalian T-cells. CAR-Ts can further contain multiple signaling domains such as CD28, 41BB or OX40, to further modulate immunomodulatory response of the T-cell. CD3-z contains a conserved motif known as an immunoreceptor tyrosine-based activation motif (ITAM) which is involved in T-cell receptor signal transduction.

The term "collectively" or "collective" when used in reference to cytokine production induced by the presence of two or more variant CD80 polypeptides in an in vitro assay, means the overall cytokine expression level irrespective of the cytokine production induced by individual variant CD80 polypeptides. In some embodiments, the cytokine being assayed is IFN-gamma in an in vitro primary T-cell assay such as described in Example 7.

The term "cognate binding partner" (used interchangeably with "counter-structure") in reference to a polypeptide, such as in reference to an IgSF domain of a variant CD80, refers to at least one molecule (typically a native mammalian protein) to which the referenced polypeptide specifically binds under specific binding conditions. In some aspects, a variant CD80 containing an affinity modified IgSF domain specifically binds to the counter-structure of the corresponding native or wildtype CD80 but with increased or attenuated affinity. A species of ligand recognized and specifically binding to its cognate receptor under specific binding conditions is an example of a counter-structure or cognate binding partner of that receptor. A "cognate cell surface binding partner" is a cognate binding partner expressed on a mammalian cell surface. A "cell surface molecular species" is a cognate binding partner of ligands of the immunological synapse (IS), expressed on and by cells, such as mammalian cells, forming the immunological synapse.

As used herein, "conjugate," "conjugation" or grammatical variations thereof refers the joining or linking together of two or more compounds resulting in the formation of another compound, by any joining or linking methods known in the art. It can also refer to a compound which is generated by the joining or linking together two or more compounds. For example, a variant CD80 polypeptide linked directly or indirectly to one or more chemical moieties or polypeptide is an exemplary conjugate. Such conjugates include fusion proteins, those produced by chemical conjugates and those produced by any other methods.

The term "competitive binding" as used herein means that a protein is capable of specifically binding to at least two cognate binding partners but that specific binding of one cognate binding partner inhibits, such as prevents or precludes, simultaneous binding of the second cognate binding partner. Thus, in some cases, it is not possible for a protein to bind the two cognate binding partners at the same time. Generally, competitive binders contain the same or overlapping binding site for specific binding but this is not a requirement. In some embodiments, competitive binding causes a measurable inhibition (partial or complete) of specific binding of a protein to one of its cognate binding partner due to specific binding of a second cognate binding partner. A variety of methods are known to quantify competitive binding such as ELISA (enzyme linked immunosorbent assay) assays.

The term "conservative amino acid substitution" as used herein means an amino acid substitution in which an amino acid residue is substituted by another amino acid residue having a side chain R group with similar chemical properties (e.g., charge or hydrophobicity). Examples of groups of amino acids that have side chains with similar chemical properties include 1) aliphatic side chains: glycine, alanine, valine, leucine, and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartic acid and glutamic acid; and 7) sulfur-containing side chains: cysteine and methionine. Conservative amino acids substitution groups are: valine-leucine-isoleucine, phenylalanine-tyrosine, lysine-arginine, alanine-valine, glutamate-aspartate, and asparagine-glutamine.

The term, "corresponding to" with reference to positions of a protein, such as recitation that nucleotides or amino acid positions "correspond to" nucleotides or amino acid positions in a disclosed sequence, such as set forth in the Sequence Listing, refers to nucleotides or amino acid positions identified upon alignment with the disclosed sequence based on structural sequence alignment or using a standard alignment algorithm, such as the GAP algorithm. For example, corresponding residues can be determined by alignment of a reference sequence with the sequence of wild-type CD80 set forth in SEQ ID NO: 2 (ECD domain) or set forth in SEQ ID NO: 76, 3030 or 3031 (IgV domain) by structural alignment methods as described herein. By aligning the sequences, one skilled in the art can identify corresponding residues, for example, using conserved and identical amino acid residues as guides.

The terms "decrease" or "attenuate" "or suppress" as used herein means to decrease by a statistically significant amount. A decrease can be at least 10%, 20%, 30%, 40%, 50%, 60%, 70%, 80%, 90%, or 100%.

The terms "derivatives" or "derivatized" refer to modification of a protein by covalently linking it, directly or indirectly, to a composition so as to alter such characteristics as biological half-life, bioavailability, immunogenicity, solubility, toxicity, potency, or efficacy while retaining or enhancing its therapeutic benefit. Derivatives of immunomodulatory polypeptides of the invention are within the scope of the invention and can be made by, for example, glycosylation, PEGylation, lipidation, or Fc-fusion.

As used herein, detection includes methods that permit visualization (by eye or equipment) of a protein. A protein can be visualized using an antibody specific to the protein. Detection of a protein can also be facilitated by fusion of the protein with a tag including a label that is detectable or by contact with a second reagent specific to the protein, such as a secondary antibody, that includes a label that is detectable.

As used herein, domain (typically a sequence of three or more, generally 5 or 7 or more amino acids, such as 10 to 200 amino acid residues) refers to a portion of a molecule, such as a protein or encoding nucleic acid, that is structurally and/or functionally distinct from other portions of the molecule and is identifiable. For example, domains include those portions of a polypeptide chain that can form an independently folded structure within a protein made up of one or more structural motifs and/or that is recognized by virtue of a functional activity, such as binding activity. A protein can have one, or more than one, distinct domains. For example, a domain can be identified, defined or distinguished by homology of the primary sequence or structure to related family members, such as homology to motifs. In another example, a domain can be distinguished by its function, such as an ability to interact with a biomolecule, such as a cognate binding partner. A domain independently can exhibit a biological function or activity such that the domain independently or fused to another molecule can perform an activity, such as, for example binding. A domain can be a linear sequence of amino acids or a non-linear sequence of amino acids. Many polypeptides contain a plurality of domains. Such domains are known, and can be identified by those of skill in the art. For exemplification herein, definitions are provided, but it is understood that it is well within the skill in the art to recognize particular domains by name. If needed appropriate software can be employed to identify domains.

The term "ectodomain" as used herein refers to the region of a membrane protein, such as a transmembrane protein, that lies outside the vesicular membrane. Ectodomains often contain binding domains that specifically bind to ligands or cell surface receptors, such as via a binding domain that specifically binds to the ligand or cell surface receptor. The ectodomain of a cellular transmembrane protein is alternately referred to as an extracellular domain.

The terms "effective amount" or "therapeutically effective amount" refer to a quantity and/or concentration of a therapeutic composition of the invention, including a protein composition or cell composition, that when administered ex vivo (by contact with a cell from a patient) or in vivo (by administration into a patient) either alone (i.e., as a monotherapy) or in combination with additional therapeutic agents, yields a statistically significant decrease in disease progression as, for example, by ameliorating or eliminating symptoms and/or the cause of the disease. An effective amount may be an amount that relieves, lessens, or alleviates at least one symptom or biological response or effect associated with a disease or disorder, prevents progression of the disease or disorder, or improves physical functioning of the patient. In the case of cell therapy, the effective amount is an effective dose or number of cells administered to a patient by adoptive cell therapy. In some embodiments the patient is a mammal such as a non-human primate or human patient.

The term "endodomain" as used herein refers to the region found in some membrane proteins, such as transmembrane proteins, that extend into the interior space defined by the cell surface membrane. In mammalian cells, the endodomain is the cytoplasmic region of the membrane protein. In cells, the endodomain interacts with intracellular constituents and can be play a role in signal transduction and thus, in some cases, can be an intracellular signaling domain. The endodomain of a cellular transmembrane protein is alternately referred to as a cytoplasmic domain, which, in some cases, can be a cytoplasmic signaling domain.

The terms "enhanced" or "increased" as used herein in the context of increasing immunological activity of a mammalian lymphocyte means to increase one or more activities the lymphocyte. An increased activity can be one or more of increase cell survival, cell proliferation, cytokine production, or T-cell cytotoxicity, such as by a statistically significant amount. In some embodiments, reference to increased immunological activity means to increase interferon gamma (IFN-gamma) production, such as by a statistically significant amount. In some embodiments, the immunological activity can be assessed in a mixed lymphocyte reaction (MLR) assay. Methods of conducting MLR assays are known in the art. Wang et al., Cancer Immunol Res. 2014 September: 2(9):846-56. Other methods of assessing activities of lymphocytes are known in the art, including any assay as described herein. In some embodiments an enhancement can be an increase of at least 10%, 20%, 30%, 40%, 50%, 75%, 100%, 200%, 300%, 400%, or 500% greater than a non-zero control value.

The term "engineered cell" as used herein refers to a mammalian cell that has been genetically modified by human intervention such as by recombinant DNA methods or viral transduction. In some embodiments, the cell is an immune cell, such as a lymphocyte (e.g., T cell, B cell, NK cell) or an antigen presenting cell (e.g., dendritic cell). The cell can be a primary cell from a patient or can be a cell line. In some embodiments, an engineered cell of the invention contains a variant CD80 of the invention engineered to modulate immunological activity of a T-cell expressing CD28, PD-L1 and/or CTLA-4, or an APC expressing PD-L1, to which the variant CD80 polypeptide specifically binds. In some embodiments, the variant CD80 is a transmembrane immunomodulatory protein (hereinafter referred to as "TIP") containing the extracellular domain or a portion thereof containing the IgV domain linked to a transmembrane domain (e.g., a CD80 transmembrane domain) and, optionally, an intracellular signaling domain. In some cases, the TIP is formatted as a chimeric receptor containing a heterologous cytoplasmic signaling domain or endodomain. In some embodiments, an engineered cell is capable of expressing and secreting an immunomodulatory protein as described herein. Among provided engineered cells also are cells further containing an engineered T-cell receptor (TCR) or chimeric antigen receptor (CAR).

The term "engineered T-cell" as used herein refers to a T-cell such as a T helper cell, cytotoxic T-cell (alternatively, cytotoxic T lymphocyte or CTL), natural killer T-cell, regulatory T-cell, memory T-cell, or gamma delta T-cell, that has been genetically modified by human intervention such as by recombinant DNA methods or viral transduction methods. An engineered T-cell contains a variant CD80 transmembrane immunomodulatory protein (TIP) or secreted immunomodulatory protein (SIP) of the present invention that is expressed on the T-cell and is engineered to modulate immunological activity of the engineered T-cell itself, or a mammalian cell to which the variant CD80 expressed on the T-cell specifically binds.

The term "engineered T-cell receptor" or "engineered TCR" refers to a T-cell receptor (TCR) engineered to specifically bind with a desired affinity to a major histocompatibility complex (MHC)/peptide target antigen that is selected, cloned, and/or subsequently introduced into a population of T-cells, often used for adoptive immunotherapy. In contrast to engineered TCRs, CARs are engineered to bind target antigens in a MHC independent manner.

The term "expressed on" as used herein is used in reference to a protein expressed on the surface of a cell, such as a mammalian cell. Thus, the protein is expressed as a membrane protein. In some embodiments, the expressed protein is a transmembrane protein. In some embodiments, the protein is conjugated to a small molecule moiety such as a drug or detectable label. Proteins expressed on the surface of a cell can include cell-surface proteins such as cell surface receptors that are expressed on mammalian cells.

The term "half-life extending moiety" refers to a moiety of a polypeptide fusion or chemical conjugate that extends the half-life of a protein circulating in mammalian blood serum compared to the half-life of the protein that is not so conjugated to the moiety. In some embodiments, half-life is extended by greater than or greater than about 1.2-fold, 1.5-fold, 2.0-fold, 3.0-fold, 4.0-fold, 5.0-fold, or 6.0-fold. In some embodiments, half-life is extended by more than 6 hours, more than 12 hours, more than 24 hours, more than 48 hours, more than 72 hours, more than 96 hours or more than 1 week after in vivo administration compared to the protein without the half-life extending moiety. The half-life refers to the amount of time it takes for the protein to lose half of its concentration, amount, or activity. Half-life can be determined for example, by using an ELISA assay or an activity assay. Exemplary half-life extending moieties include an Fc domain, a multimerization domain, polyethylene glycol (PEG), hydroxyethyl starch (HES), XTEN (extended recombinant peptides; see, WO2013130683), human serum albumin (HSA), bovine serum albumin (BSA), lipids (acylation), and poly-Pro-Ala-Ser (PAS), and polyglutamic acid (glutamylation).

The term "immunological synapse" or "immune synapse" as used herein means the interface between a mammalian cell that expresses MHC I (major histocompatibility complex) or MHC II, such as an antigen-presenting cell or tumor cell, and a mammalian lymphocyte such as an effector T cell or Natural Killer (NK) cell.

Figure 6A:
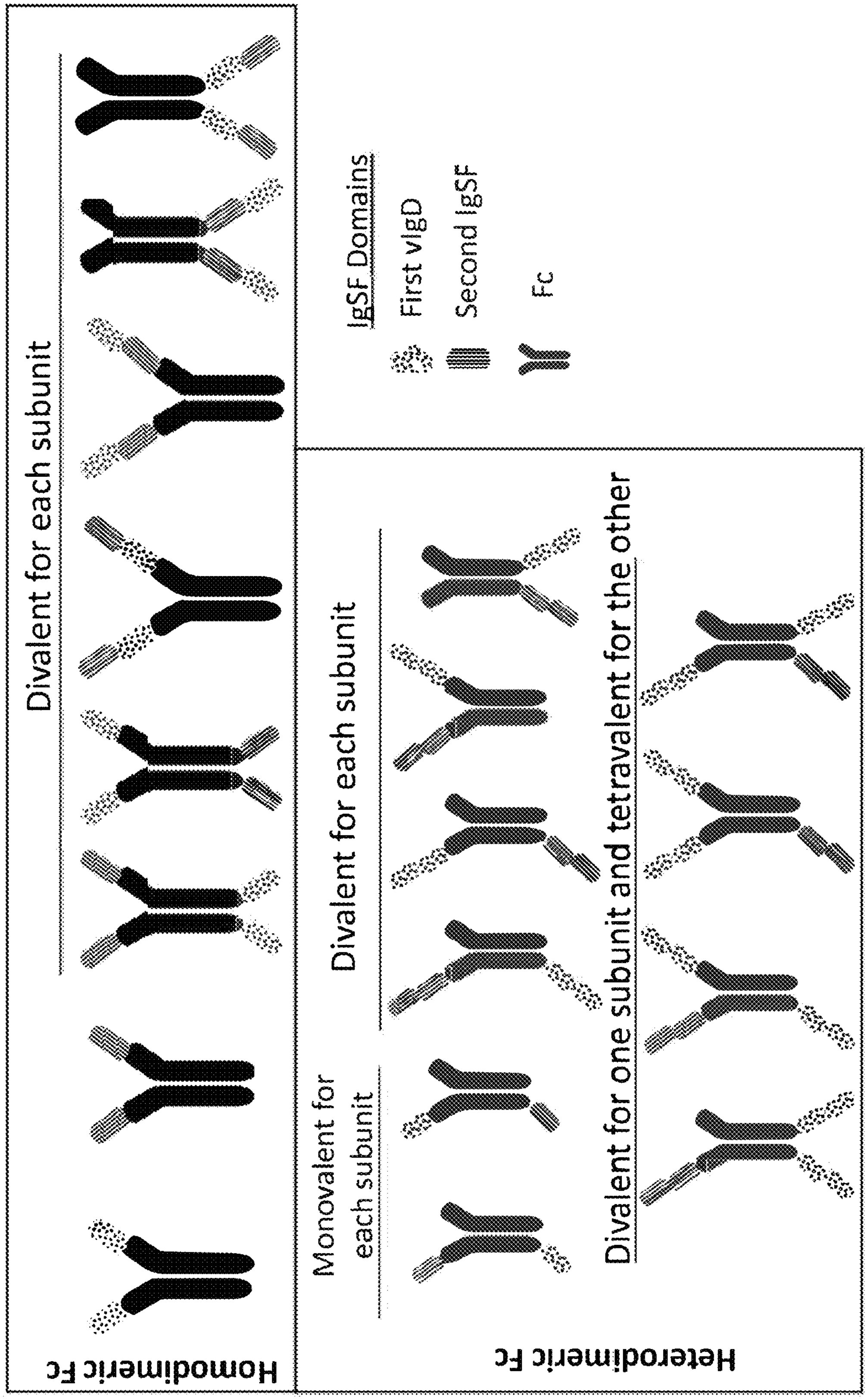
FIG. 6A depicts various exemplary configurations of a stack molecule containing a first variant IgSF domain (first vIgD) and a second IgSF domain, such as a second variant IgSF domain (second vIgD). As shown, the first vIgD and second IgSF domain are independently linked, directly or indirectly, to the N- or C-terminus of an Fc region. For generating a homodimeric Fc molecule, the Fc region is one that is capable of forming a homodimer with a matched Fc region by co-expression of the individual Fc regions in a cell. For generating a heterodimeric Fc molecule, the individual Fc regions contain mutations (e.g., "knob-into-hole" mutations in the CH3 domain), such that formation of the heterodimer is favored compared to homodimers when the individual Fc regions are co-expressed in a cell.
Figure 6B:
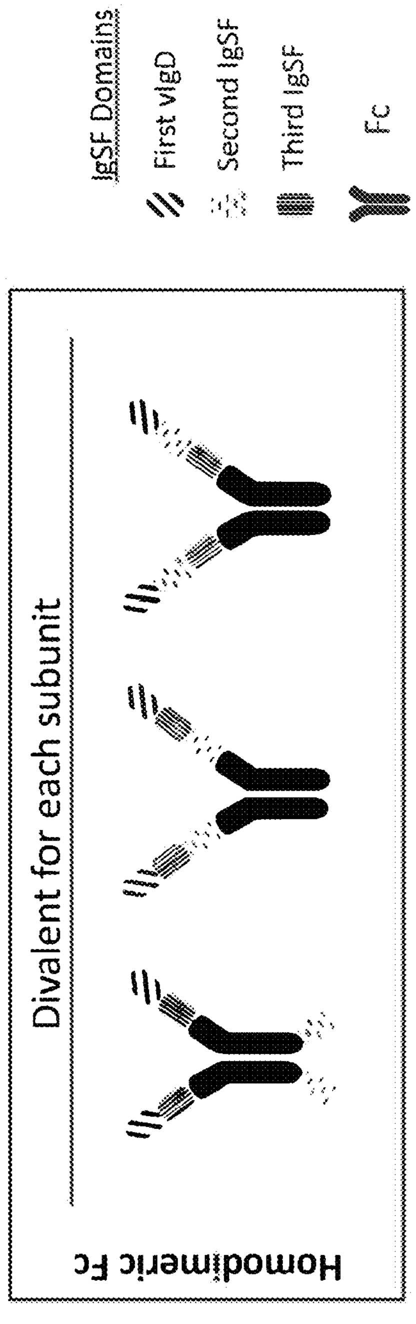
FIG. 6B depicts various exemplary configurations of a stack molecule containing a first variant IgSF domain (first vIgD), a second IgSF domain, such as a second variant IgSF domain (second vIgD), and a third IgSF domain, such as a third variant IgSF domain (third vIgD). As shown, the first vIgD, second IgSF, and third IgSF domains are independently linked, directly or indirectly, to the N- or C-terminus of an Fc region. For generating a homodimeric Fc molecule, the Fc region is one that is capable of forming a homodimer with a matched Fc region by co-expression of the individual Fc regions in a cell.

An Fc (fragment crystallizable) region or domain of an immunoglobulin molecule (also termed an Fc polypeptide) corresponds largely to the constant region of the immunoglobulin heavy chain, and is responsible for various functions, including the antibody's effector function(s). The Fc domain contains part or all of a hinge domain of an immunoglobulin molecule plus a CH2 and a CH3 domain. The Fc domain can form a dimer of two polypeptide chains joined by one or more disulfide bonds. Exemplary dimerized polypeptides are depicted in FIGS. 6A and 6B. In some embodiments, the Fc is a variant Fc that exhibits reduced (e.g., reduced greater than 30%, 40%, 50%, 60%, 70%, 80%, 90% or more) activity to facilitate an effector function. In some embodiments, reference to amino acid substitutions in an Fc region is by EU numbering system unless described with reference to a specific SEQ ID NO. EU numbering is known and is according to the most recently updated IMGT Scientific Chart (IMGT®, the international ImMunoGeneTics information system@, http://www.imgt.org/IMGTScientificChart/Numbering/Hu_IGHGnber.html (created: 17 May 2001, last updated: 10 Jan. 2013) and the EU index as reported in Kabat, E. A. et al. Sequences of Proteins of Immunological interest. 5th ed. US Department of Health and Human Services, NIH publication No. 91-3242 (1991).

An immunoglobulin Fc fusion ("Fc-fusion"), such as an immunomodulatory Fc fusion protein, is a molecule comprising one or more polypeptides (or one or more small molecules) operably linked to an Fc region of an immunoglobulin. An Fc-fusion may comprise, for example, the Fc region of an antibody (which facilitates pharmacokinetics) and a variant CD80 polypeptide. An immunoglobulin Fc region may be linked indirectly or directly to one or more variant CD80 polypeptides or small molecules (fusion partners). Various linkers are known in the art and can optionally be used to link an Fc to a fusion partner to generate an Fc-fusion. Fc-fusions of identical species can be dimerized to form Fc-fusion homodimers, or using non-identical species to form Fc-fusion heterodimers. In some embodiments, the Fc is a mammalian Fc such as a murine, rabbit or human Fc.

The term "host cell" refers to a cell that can be used to express a protein encoded by a recombinant expression vector. A host cell can be a prokaryote, for example, *E. coli*, or it can be a eukaryote, for example, a single-celled eukaryote (e.g., a yeast or other fungus), a plant cell (e.g., a tobacco or tomato plant cell), an animal cell (e.g., a human cell, a monkey cell, a hamster cell, a rat cell, a mouse cell, or an insect cell) or a hybridoma. Examples of host cells include Chinese hamster ovary (CHO) cells or their derivatives such as Veggie CHO, DG44, Expi CHO, or CHOZN and related cell lines which grow in serum-free media or CHO strain DX-B11, which is deficient in DHFR. In some embodiments, a host cell can be a mammalian cell (e.g., a human cell, a monkey cell, a hamster cell, a rat cell, a mouse cell, or an insect cell).

The term "immunoglobulin" (abbreviated "Ig") as used herein refers to a mammalian immunoglobulin protein including any of the five human classes of antibody: IgA (which includes subclasses IgA1 and IgA2), IgD, IgE, IgG (which includes subclasses IgG1, IgG2, IgG3, and IgG4), and IgM. The term is also inclusive of immunoglobulins that are less than full-length, whether wholly or partially synthetic (e.g., recombinant or chemical synthesis) or naturally produced, such as antigen binding fragment (Fab), variable fragment (Fv) containing $V_H$ and $V_L$, the single chain variable fragment (scFv) containing $V_H$ and $V_L$ linked together in one chain, as well as other antibody V region fragments, such as Fab', $F(ab)_2$, $F(ab')_2$, dsFv diabody, Fc, and Fd polypeptide fragments. Bispecific antibodies, homobispecific and heterobispecific, are included within the meaning of the term.

The term "immunoglobulin superfamily" or "IgSF" as used herein means the group of cell surface and soluble proteins that are involved in the recognition, binding, or adhesion processes of cells. Molecules are categorized as members of this superfamily based on shared structural features with immunoglobulins (i.e., antibodies); they all possess a domain known as an immunoglobulin domain or fold. Members of the IgSF include cell surface antigen receptors, co-receptors and co-stimulatory molecules of the immune system, molecules involved in antigen presentation to lymphocytes, cell adhesion molecules, certain cytokine receptors and intracellular muscle proteins. They are commonly associated with roles in the immune system. Proteins in the immunological synapse are often members of the IgSF. IgSF can also be classified into "subfamilies" based on shared properties such as function. Such subfamilies typically consist of from 4 to 30 IgSF members.

The terms "IgSF domain" or "immunoglobulin domain" or "Ig domain" as used herein refers to a structural domain of IgSF proteins. Ig domains are named after the immunoglobulin molecules. They contain about 70-110 amino acids and are categorized according to their size and function. Ig-domains possess a characteristic Ig-fold, which has a sandwich-like structure formed by two sheets of antiparallel beta strands. Interactions between hydrophobic amino acids on the inner side of the sandwich and highly conserved disulfide bonds formed between cysteine residues in the B and F strands stabilize the Ig-fold. One end of the Ig domain has a section called the complementarity determining region that is important for the specificity of antibodies for their ligands. The Ig like domains can be classified (into classes) as: IgV, IgC1, IgC2, or IgI. Most Ig domains are either variable (IgV) or constant (IgC). IgV domains with 9 beta strands are generally longer than IgC domains with 7 beta strands. Ig domains of some members of the IgSF resemble IgV domains in the amino acid sequence, yet are similar in size to IgC domains. These are called IgC2 domains, while standard IgC domains are called IgC1 domains. T-cell receptor (TCR) chains contain two Ig domains in the extracellular portion; one IgV domain at the N-terminus and one IgC1 domain adjacent to the cell membrane. CD80 contains two Ig domains: IgV and IgC.

The term "IgSF species" as used herein means an ensemble of IgSF member proteins with identical or substantially identical primary amino acid sequence. Each mammalian immunoglobulin superfamily (IgSF) member defines a unique identity of all IgSF species that belong to that IgSF member. Thus, each IgSF family member is unique from other IgSF family members and, accordingly, each species of a particular IgSF family member is unique from the species of another IgSF family member. Nevertheless, variation between molecules that are of the same IgSF species may occur owing to differences in post-translational modification such as glycosylation, phosphorylation, ubiquitination, nitrosylation, methylation, acetylation, and lipidation. Additionally, minor sequence differences within a single IgSF species owing to gene polymorphisms constitute another form of variation within a single IgSF species as do wild type truncated forms of IgSF species owing to, for example, proteolytic cleavage. A "cell surface IgSF species" is an IgSF species expressed on the surface of a cell, generally a mammalian cell.

The term "immunological activity" as used herein in the context of mammalian lymphocytes such as T-cells refers to one or more cell survival, cell proliferation, cytokine production (e.g., interferon-gamma), or T-cell cytotoxicity activities. In some cases, an immunological activity can means their expression of cytokines, such as chemokines or interleukins. Assays for determining enhancement or suppression of immunological activity include the MLR (mixed lymphocyte reaction) assays measuring interferon-gamma cytokine levels in culture supernatants (Wang et al., Cancer Immunol Res. 2014 September: 2(9):846-56), SEB (staphylococcal enterotoxin B) T cell stimulation assay (Wang et al., Cancer Immunol Res. 2014 September: 2(9):846-56), and anti-CD3 T cell stimulation assays (Li and Kurlander, J Transl Med. 2010: 8: 104). Since T cell activation is associated with secretion of IFN-gamma cytokine, detecting IFN-gamma levels in culture supernatants from these in vitro human T cell assays can be assayed using commercial ELISA kits (Wu et al, Immunol Lett 2008 Apr. 15; 117(1): 57-62). Induction of an immune response results in an increase in immunological activity relative to quiescent lymphocytes. An immunomodulatory protein, such as a variant CD80 polypeptide containing an affinity modified IgSF domain, as provided herein can in some embodiments increase or, in alternative embodiments, decrease IFN-gamma (interferon-gamma) expression in a primary T-cell assay relative to a wild-type IgSF member or IgSF domain control. Those of skill will recognize that the format of the primary T-cell assay used to determine an increase in IFN-gamma expression will differ from that employed to assay for a decrease in IFN-gamma expression. In assaying for the ability of an immunomodulatory protein or affinity modified IgSF domain of the invention to decrease IFN-gamma expression in a primary T-cell assay, a Mixed Lymphocyte Reaction (MLR) assay can be used as described in Example 6. Conveniently, a soluble form of an affinity modified IgSF domain of the invention can be employed to determine its ability to antagonize and thereby decrease the IFN-gamma expression in a MLR as likewise described in Example 6. Alternatively, in assaying for the ability of an immunomodulatory protein or affinity modified IgSF domain of the invention to increase IFN-gamma expression in a primary T-cell assay, a co-immobilization assay can be used. In a co-immobilization assay, a T-cell receptor signal, provided in some embodiments by anti-CD3 antibody, is used in conjunction with a co-immobilized affinity modified IgSF domain, such as a variant CD80, to determine the ability to increase IFN-gamma expression relative to a wild-type IgSF domain control. Methods to assay the immunological activity of engineered cells, including to evaluate the activity of a variant CD80 transmembrane immunomodulatory protein, are known in the art and include, but are not limited to, the ability to expand T cells following antigen stimulation, sustain T cell expansion in the absence of re-stimulation, and anti-cancer activities in appropriate animal models. Assays also include assays to assess cytotoxicity, including a standard $^{51}$Cr-release assay (see e.g., Milone et al., (2009) Molecular Therapy 17: 1453-1464) or flow based cytotoxicity assays, or an impedance based cytotoxicity assay (Peper et al. (2014) Journal of Immunological Methods, 405:192-198).

An "immunomodulatory polypeptide" or "immunomodulatory protein" is a polypeptide or protein molecule that modulates immunological activity. By "modulation" or "modulating" an immune response is meant that immunological activity is either increased or decreased. An immunomodulatory protein can be a single polypeptide chain or a multimer (dimers or higher order multimers) of at least two polypeptide chains covalently bonded to each other by, for example, interchain disulfide bonds. Thus, monomeric, dimeric, and higher order multimeric polypeptides are within the scope of the defined term. Multimeric polypeptides can be homomultimeric (of identical polypeptide chains) or heteromultimeric (of non-identical polypeptide chains). An immunomodulatory protein can comprise a variant CD80 polypeptide.

The term "increase" as used herein means to increase by a statistically significant amount. An increase can be at least 5%, 10%, 20%, 30%, 40%, 50%, 75%, 100%, or greater than a non-zero control value.

An "isoform" of CD80 is one of a plurality of naturally occurring CD80 polypeptides that differ in amino acid sequence. Isoforms can be the product of splice variants of an RNA transcript expressed by a single gene, or the expression product of highly similar but different genes yielding a functionally similar protein such as may occur from gene duplication. As used herein, the term "isoform" of CD80 also refers to the product of different alleles of a CD80 gene.

The term "label" refers to a compound or composition which can be attached or linked, directly or indirectly to provide a detectable signal or that can interact with a second label to modify a detectable signal. The label can be conjugated directly or indirectly to a polypeptide so as to generate a labeled polypeptide. The label can be detectable by itself (e.g., radioisotope labels or fluorescent labels) or, in the case of an enzymatic label, can catalyze chemical alteration of a substrate compound composition which is detectable. Non-limiting examples of labels included fluorogenic moieties, green fluorescent protein, or luciferase.

The term "lymphocyte" as used herein means any of three subtypes of white blood cell in a mammalian immune system. They include natural killer cells (NK cells) (which function in cell-mediated, cytotoxic innate immunity), T cells (for cell-mediated, cytotoxic adaptive immunity), and B cells (for humoral, antibody-driven adaptive immunity). T cells include: T helper cells, cytotoxic T-cells, natural killer T-cells, memory T-cells, regulatory T-cells, or gamma delta T-cells. Innate lymphoid cells (ILC) are also included within the definition of lymphocyte.

The terms "mammal," or "patient" specifically includes reference to at least one of a: human, chimpanzee, rhesus monkey, cynomolgus monkey, dog, cat, mouse, or rat.

The term "membrane protein" as used herein means a protein that, under physiological conditions, is attached directly or indirectly to a lipid bilayer. A lipid bilayer that forms a membrane can be a biological membrane such as a eukaryotic (e.g., mammalian) cell membrane or an artificial (i.e., man-made) membrane such as that found on a liposome. Attachment of a membrane protein to the lipid bilayer can be by way of covalent attachment, or by way of non-covalent interactions such as hydrophobic or electrostatic interactions. A membrane protein can be an integral membrane protein or a peripheral membrane protein. Membrane proteins that are peripheral membrane proteins are non-covalently attached to the lipid bilayer or non-covalently attached to an integral membrane protein. A peripheral membrane protein forms a temporary attachment to the lipid bilayer such that under the range of conditions that are physiological in a mammal, peripheral membrane protein can associate and/or disassociate from the lipid bilayer. In contrast to peripheral membrane proteins, integral membrane proteins form a substantially permanent attachment to the membrane's lipid bilayer such that under the range of conditions that are physiological in a mammal, integral membrane proteins do not disassociate from their attachment to the lipid bilayer. A membrane protein can form an attachment to the membrane by way of one layer of the lipid bilayer (monotopic), or attached by way of both layers of the membrane (polytopic). An integral membrane protein that interacts with only one lipid bilayer is an "integral monotopic protein". An integral membrane protein that interacts with both lipid bilayers is an "integral polytopic protein" alternatively referred to herein as a "transmembrane protein".

The terms "modulating" or "modulate" as used herein in the context of an immune response, such as a mammalian immune response, refer to any alteration, such as an increase or a decrease, of existing or potential immune responses that occurs as a result of administration of an immunomodulatory polypeptide comprising a variant CD80 of the present invention or as a result of administration of engineered cells expresses an immunomodulatory protein, such as a variant CD80 transmembrane immunomodulatory protein of the present invention. Thus, it refers to an alteration, such as an increase or decrease, of an immune response as compared to the immune response that occurs or is present in the absence of the administration of the immunomodulatory protein comprising the variant CD80. Such modulation includes any induction, activation, suppression or alteration in degree or extent of immunological activity of an immune cell. Immune cells include B cells, T cells, NK (natural killer) cells, NK T cells, professional antigen-presenting cells (APCs), and non-professional antigen-presenting cells, and inflammatory cells (neutrophils, macrophages, monocytes, eosinophils, and basophils). Modulation includes any change imparted on an existing immune response, a developing immune response, a potential immune response, or the capacity to induce, regulate, influence, or respond to an immune response. Modulation includes any alteration in the expression and/or function of genes, proteins and/or other molecules in immune cells as part of an immune response. Modulation of an immune response or modulation of immunological activity includes, for example, the following: elimination, deletion, or sequestration of immune cells; induction or generation of immune cells that can modulate the functional capacity of other cells such as autoreactive lymphocytes, antigen presenting cells, or inflammatory cells; induction of an unresponsive state in immune cells (i.e., anergy); enhancing or suppressing the activity or function of immune cells, including but not limited to altering the pattern of proteins expressed by these cells. Examples include altered production and/or secretion of certain classes of molecules such as cytokines, chemokines, growth factors, transcription factors, kinases, costimulatory molecules, or other cell surface receptors or any combination of these modulatory events. Modulation can be assessed, for example, by an alteration in IFN-gamma (interferon gamma) expression relative to the wild-type or unmodified CD80 control in a primary T cell assay (see, Zhao and Ji, Exp Cell Res. 2016 Jan. 1; 340(1): 132-138). Modulation can be assessed, for example, by an alteration of an immunological activity of engineered cells, such as an alteration in in cytotoxic activity of engineered cells or an alteration in cytokine secretion of engineered cells relative to cells engineered with a wild-type CD80 transmembrane protein.

The term, a "multimerization domain" refers to a sequence of amino acids that promotes stable interaction of a polypeptide molecule with one or more additional polypeptide molecules, each containing a complementary multimerization domain (e.g., a first multimerization domain and a second multimerization domain), which can be the same or a different multimerization domain. The interactions between complementary multimerization domains, e.g., interaction between a first multimerization domain and a second multimerization domain, form a stable protein-protein interaction to produce a multimer of the polypeptide molecule with the additional polypeptide molecule. In some cases, the multimerization domain is the same and interacts with itself to form a stable protein-protein interaction between two polypeptide chains.. Generally, a polypeptide is joined directly or indirectly to the multimerization domain. Exemplary multimerization domains include the immunoglobulin sequences or portions thereof, leucine zippers, hydrophobic regions, hydrophilic regions, and compatible protein-protein interaction domains. The multimerization domain, for example, can be an immunoglobulin constant region or domain, such as, for example, the Fc domain or portions thereof from IgG, including IgG1, IgG2, IgG3 or IgG4 subtypes, IgA, IgE, IgD and IgM and modified forms thereof.

The terms "nucleic acid" and "polynucleotide" are used interchangeably to refer to a polymer of nucleic acid residues (e.g., deoxyribonucleotides or ribonucleotides) in either single- or double-stranded form. Unless specifically limited, the terms encompass nucleic acids containing known analogues of natural nucleotides and that have similar binding properties to it and are metabolized in a manner similar to naturally-occurring nucleotides. Unless otherwise indicated, a particular nucleic acid sequence also implicitly encompasses conservatively modified variants thereof (e.g., degenerate codon substitutions) and complementary nucleotide sequences as well as the sequence explicitly indicated (a "reference sequence"). Specifically, degenerate codon substitutions may be achieved by generating sequences in which the third position of one or more selected (or all) codons is substituted with mixed-base and/or deoxyinosine residues. The term nucleic acid or polynucleotide encompasses cDNA or mRNA encoded by a gene.

The term "molecular species" as used herein means an ensemble of proteins with identical or substantially identical primary amino acid sequence. Each mammalian immunoglobulin superfamily (IgSF) member defines a collection of identical or substantially identical molecular species. Thus, for example, human CD80 is an IgSF member and each human CD80 molecule is a molecular species of CD80. Variation between molecules that are of the same molecular species may occur owing to differences in post-translational modification such as glycosylation, phosphorylation, ubiquitination, nitrosylation, methylation, acetylation, and lipidation. Additionally, minor sequence differences within a single molecular species owing to gene polymorphisms constitute another form of variation within a single molecular species as do wild type truncated forms of a single molecular species owing to, for example, proteolytic cleavage. A "cell surface molecular species" is a molecular species expressed on the surface of a mammalian cell. Two or more different species of protein, each of which is present exclusively on one or exclusively the other (but not both) of the two mammalian cells forming the IS, are said to be in "cis" or "cis configuration" with each other. Two different species of protein, the first of which is exclusively present on one of the two mammalian cells forming the IS and the second of which is present exclusively on the second of the two mammalian cells forming the IS, are said to be in "trans" or "trans configuration." Two different species of protein each of which is present on both of the two mammalian cells forming the IS are in both cis and trans configurations on these cells.

The term "non-competitive binding" as used herein means the ability of a protein to specifically bind simultaneously to at least two cognate binding partners. Thus, the protein is able to bind to at least two different cognate binding partners at the same time, although the binding interaction need not be for the same duration such that, in some cases, the protein is specifically bound to only one of the cognate binding partners. In some embodiments, the binding occurs under specific binding conditions. In some embodiments, the simultaneous binding is such that binding of one cognate binding partner does not substantially inhibit simultaneous binding to a second cognate binding partner. In some embodiments, non-competitive binding means that binding a second cognate binding partner to its binding site on the protein does not displace the binding of a first cognate binding partner to its binding site on the protein. Methods of assessing non-competitive binding are well known in the art such as the method described in Perez de La Lastra et al., Immunology, 1999 April: 96(4): 663-670. In some cases, in non-competitive interactions, the first cognate binding partner specifically binds at an interaction site that does not overlap with the interaction site of the second cognate binding partner such that binding of the second cognate binding partner does not directly interfere with the binding of the first cognate binding partner. Thus, any effect on binding of the cognate binding partner by the binding of the second cognate binding partner is through a mechanism other than direct interference with the binding of the first cognate binding partner. For example, in the context of enzyme-substrate interactions, a non-competitive inhibitor binds to a site other than the active site of the enzyme. Non-competitive binding encompasses uncompetitive binding interactions in which a second cognate binding partner specifically binds at an interaction site that does not overlap with the binding of the first cognate binding partner but binds to the second interaction site only when the first interaction site is occupied by the first cognate binding partner.

The term "pharmaceutical composition" refers to a composition suitable for pharmaceutical use in a mammalian subject, often a human. A pharmaceutical composition typically comprises an effective amount of an active agent (e.g., an immunomodulatory polypeptide comprising a variant CD80 or engineered cells expressing a variant CD80 transmembrane immunomodulatory protein) and a carrier, excipient, or diluent. The carrier, excipient, or diluent is typically a pharmaceutically acceptable carrier, excipient or diluent, respectively.

The terms "polypeptide" and "protein" are used interchangeably herein and refer to a molecular chain of two or more amino acids linked through peptide bonds. The terms do not refer to a specific length of the product. Thus, "peptides," and "oligopeptides," are included within the definition of polypeptide. The terms include post-translational modifications of the polypeptide, for example, glycosylation, acetylation, phosphorylation and the like. The terms also include molecules in which one or more amino acid analogs or non-canonical or unnatural amino acids that can be synthesized, or expressed recombinantly using known protein engineering techniques. In addition, proteins can be derivatized.

The term "primary T-cell assay" as used herein refers to an in vitro assay to measure interferon-gamma ("IFN-gamma") expression. A variety of such primary T-cell assays are known in the art such as that described in Example 6. In a preferred embodiment, the assay used is anti-CD3 coimmobilization assay. In this assay, primary T cells are stimulated by anti-CD3 immobilized with or without additional recombinant proteins. Culture supernatants are harvested at timepoints, usually 24-72 hours. In another embodiment, the assay used is a mixed lymphocyte reaction (MLR). In this assay, primary T cells are simulated with allogenic APC. Culture supernatants are harvested at timepoints, usually 24-72 hours. Human IFN-gamma levels are measured in culture supernatants by standard ELISA techniques. Commercial kits are available from vendors and the assay is performed according to manufacturer's recommendation.

The term "purified" as applied to nucleic acids, such as encoding immunomodulatory proteins of the invention, generally denotes a nucleic acid or polypeptide that is substantially free from other components as determined by analytical techniques well known in the art (e.g., a purified polypeptide or polynucleotide forms a discrete band in an electrophoretic gel, chromatographic eluate, and/or a media subjected to density gradient centrifugation). For example, a nucleic acid or polypeptide that gives rise to essentially one band in an electrophoretic gel is "purified." A purified nucleic acid or protein of the invention is at least about 50% pure, usually at least about 75%, 80%, 85%, 90%, 95%, 96%, 99% or more pure (e.g., percent by weight or on a molar basis).

The term "recombinant" indicates that the material (e.g., a nucleic acid or a polypeptide) has been artificially (i.e., non-naturally) altered by human intervention. The alteration can be performed on the material within, or removed from, its natural environment or state. For example, a "recombinant nucleic acid" is one that is made by recombining nucleic acids, e.g., during cloning, affinity modification, DNA shuffling or other well-known molecular biological procedures. A "recombinant DNA molecule," is comprised of segments of DNA joined together by means of such molecular biological techniques. The term "recombinant protein" or "recombinant polypeptide" as used herein refers to a protein molecule which is expressed using a recombinant DNA molecule. A "recombinant host cell" is a cell that contains and/or expresses a recombinant nucleic acid or that is otherwise altered by genetic engineering, such as by introducing into the cell a nucleic acid molecule encoding a recombinant protein, such as a transmembrane immunomodulatory protein provided herein. Transcriptional control signals in eukaryotes comprise "promoter" and "enhancer" elements. Promoters and enhancers consist of short arrays of DNA sequences that interact specifically with cellular proteins involved in transcription. Promoter and enhancer elements have been isolated from a variety of eukaryotic sources including genes in yeast, insect and mammalian cells and viruses (analogous control elements, i.e., promoters, are also found in prokaryotes). The selection of a particular promoter and enhancer depends on what cell type is to be used to express the protein of interest. The terms "in operable combination," "in operable order" and "operably linked" as used herein refer to the linkage of nucleic acid sequences in such a manner or orientation that a nucleic acid molecule capable of directing the transcription of a given gene and/or the synthesis of a desired protein molecule is produced.

The term "recombinant expression vector" as used herein refers to a DNA molecule containing a desired coding sequence and appropriate nucleic acid sequences necessary for the expression of the operably linked coding sequence in a particular host cell. Nucleic acid sequences necessary for expression in prokaryotes include a promoter, optionally an operator sequence, a ribosome binding site and possibly other sequences. Eukaryotic cells are known to utilize promoters, enhancers, and termination and polyadenylation signals. A secretory signal peptide sequence can also, optionally, be encoded by the recombinant expression vector, operably linked to the coding sequence for the recombinant protein, such as a recombinant fusion protein, so that the expressed fusion protein can be secreted by the recombinant host cell, for easier isolation of the fusion protein from the cell, if desired. The term includes the vector as a self-replicating nucleic acid structure as well as the vector incorporated into the genome of a host cell into which it has been introduced. Among the vectors are viral vectors, such as lentiviral vectors.

The term "selectivity" refers to the preference of a subject protein, or polypeptide, for specific binding of one substrate, such as one cognate binding partner, compared to specific binding for another substrate, such as a different cognate binding partner of the subject protein. Selectivity can be reflected as a ratio of the binding activity (e.g., binding affinity) of a subject protein and a first substrate, such as a first cognate binding partner, (e.g., Kai) and the binding activity (e.g., binding affinity) of the same subject protein with a second cognate binding partner (e.g., $K_{d2}$).

The term "sequence identity" as used herein refers to the sequence identity between genes or proteins at the nucleotide or amino acid level, respectively. "Sequence identity" is a measure of identity between proteins at the amino acid level and a measure of identity between nucleic acids at nucleotide level. The protein sequence identity may be determined by comparing the amino acid sequence in a given position in each sequence when the sequences are aligned. Similarly, the nucleic acid sequence identity may be determined by comparing the nucleotide sequence in a given position in each sequence when the sequences are aligned. Methods for the alignment of sequences for comparison are well known in the art, such methods include GAP, BESTFIT, BLAST, FASTA and TFASTA. The BLAST algorithm calculates percent sequence identity and performs a statistical analysis of the similarity between the two sequences. The software for performing BLAST analysis is publicly available through the National Center for Biotechnology Information (NCBI) website.

The term "soluble" as used herein in reference to proteins, means that the protein is not a membrane protein. In general, a soluble protein contains only the extracellular domain of an IgSF family member receptor, or a portion thereof containing an IgSF domain or domains or specific-binding fragments thereof, but does not contain the transmembrane domain. In some cases, solubility of a protein can be improved by linkage or attachment, directly or indirectly via a linker, to an Fc domain, which, in some cases, also can improve the stability and/or half-life of the protein. In some aspects, a soluble protein is an Fc fusion protein.

The term "species" as used herein with respect to polypeptides or nucleic acids means an ensemble of molecules with identical or substantially identical sequences. Variation between polypeptides that are of the same species may occur owing to differences in post-translational modification such as glycosylation, phosphorylation, ubiquitination, nitrosylation, methylation, acetylation, and lipidation. Slightly truncated sequences of polypeptides that differ (or encode a difference) from the full length species at the amino-terminus or carboxyl-terminus by no more than 1, 2, or 3 amino acid residues are considered to be of a single species. Such microheterogeneities are a common feature of manufactured proteins.

The term "specific binding fragment" as used herein in reference to a full-length wild-type mammalian CD80 polypeptide or an IgV or an IgC domain thereof, means a polypeptide having a subsequence of an IgV and/or IgC domain and that specifically binds in vitro and/or in vivo to a mammalian CD28, mammalian PD-L1 and/or mammalian CTLA-4, such as a human or murine CD28, PD-L1, and/or CTLA-4. In some embodiments, the specific binding fragment of the CD80 IgV or the CD80 IgC is at least 60%, 70%, 75%, 80%, 85%, 90%, 95%, 96%, 97%, 98%, or 99% the sequence length of the full-length wild-type sequence. The specific binding fragment can be altered in sequence to form the variant CD80.

The term "specifically binds" as used herein means the ability of a protein, under specific binding conditions, to bind to a target protein such that its affinity or avidity is at least 5 times as great, but optionally at least 10, 20, 30, 40, 50, 100, 250 or 500 times as great, or even at least 1000 times as great as the average affinity or avidity of the same protein to a collection of random peptides or polypeptides of sufficient statistical size. A specifically binding protein need not bind exclusively to a single target molecule but may specifically bind to a non-target molecule due to similarity in structural conformation between the target and non-target (e.g., paralogs or orthologs). Those of skill will recognize that specific binding to a molecule having the same function in a different species of animal (i.e., ortholog) or to a non-target molecule having a substantially similar epitope as the target molecule (e.g., paralog) is possible and does not detract from the specificity of binding which is determined relative to a statistically valid collection of unique non-targets (e.g., random polypeptides). Thus, a polypeptide of the invention may specifically bind to more than one distinct species of target molecule due to cross-reactivity. Solid-phase ELISA immunoassays or surface plasmon resonance (e.g., Biacore) measurements can be used to determine specific binding between two proteins. Generally, interactions between two binding proteins have dissociation constants ($K_d$) less than $1\times10^{-5}$ M, and often as low as $1\times10^{-12}$ M. In certain embodiments of the present disclosure, interactions between two binding proteins have dissociation constants of $1\times10^{-6}$ M, $1\times10^{-7}$ M, $1\times10^{-8}$ M, $1\times10^{-9}$ M, $1\times10^{-10}$ M or $1\times10^{-11}$ M.

The terms "surface expresses" or "surface expression" in reference to a mammalian cell expressing a polypeptide means that the polypeptide is expressed as a membrane protein. In some embodiments, the membrane protein is a transmembrane protein.

As used herein, "synthetic," with reference to, for example, a synthetic nucleic acid molecule or a synthetic gene or a synthetic peptide refers to a nucleic acid molecule or polypeptide molecule that is produced by recombinant methods and/or by chemical synthesis methods.

The term "targeting moiety" as used herein refers to a composition that is covalently or non-covalently attached to, or physically encapsulates, a polypeptide comprising the variant CD80. The targeting moiety has specific binding affinity for a desired counter-structure such as a cell surface receptor (e.g., the B7 family member PD-L1), or a tumor antigen such as tumor specific antigen (TSA) or a tumor associated antigen (TAA) such as B7-H6. Typically, the desired counter-structure is localized on a specific tissue or cell-type. Targeting moieties include: antibodies, antigen binding fragment (Fab), variable fragment (Fv) containing $V_H$ and $V_L$, the single chain variable fragment (scFv) containing $V_H$ and $V_L$ linked together in one chain, as well as other antibody V region fragments, such as Fab', $F(ab)_2$, $F(ab')_2$, dsFv diabody, nanobodies, soluble receptors, receptor ligands, affinity matured receptors or ligands, as well as small molecule (<500 Dalton) compositions (e.g., specific binding receptor compositions). Targeting moieties can also be attached covalently or non-covalently to the lipid membrane of liposomes that encapsulate a polypeptide of the present invention.

The term "transmembrane protein" as used herein means a membrane protein that substantially or completely spans a lipid bilayer such as those lipid bilayers found in a biological membrane such as a mammalian cell, or in an artificial construct such as a liposome. The transmembrane protein comprises a transmembrane domain ("transmembrane domain") by which it is integrated into the lipid bilayer and by which the integration is thermodynamically stable under physiological conditions. Transmembrane domains are generally predictable from their amino acid sequence via any number of commercially available bioinformatics software applications on the basis of their elevated hydrophobicity relative to regions of the protein that interact with aqueous environments (e.g., cytosol, extracellular fluid). A transmembrane domain is often a hydrophobic alpha helix that spans the membrane. A transmembrane protein can pass through the both layers of the lipid bilayer once or multiple times. A transmembrane protein includes the provided transmembrane immunomodulatory proteins described herein. In addition to the transmembrane domain, a transmembrane immunomodulatory protein of the invention further comprises an ectodomain and, in some embodiments, an endodomain.

The terms "treating," "treatment," or "therapy" of a disease or disorder as used herein mean slowing, stopping or reversing the disease or disorders progression, as evidenced by decreasing, cessation or elimination of either clinical or diagnostic symptoms, by administration of a therapeutic composition (e.g., containing an immunomodulatory protein or engineered cells) of the invention either alone or in combination with another compound as described herein. "Treating," "treatment," or "therapy" also means a decrease in the severity of symptoms in an acute or chronic disease or disorder or a decrease in the relapse rate as for example in the case of a relapsing or remitting autoimmune disease course or a decrease in inflammation in the case of an inflammatory aspect of an autoimmune disease. As used herein in the context of cancer, the terms "treatment" or, "inhibit," "inhibiting" or "inhibition" of cancer refers to at least one of: a statistically significant decrease in the rate of tumor growth, a cessation of tumor growth, or a reduction in the size, mass, metabolic activity, or volume of the tumor, as measured by standard criteria such as, but not limited to, the Response Evaluation Criteria for Solid Tumors (RECIST), or a statistically significant increase in progression free survival (PFS) or overall survival (OS). "Preventing," "prophylaxis," or "prevention" of a disease or disorder as used in the context of this invention refers to the administration of an immunomodulatory polypeptide or engineered cells of the invention, either alone or in combination with another compound, to prevent the occurrence or onset of a disease or disorder or some or all of the symptoms of a disease or disorder or to lessen the likelihood of the onset of a disease or disorder.

The term "tumor specific antigen" or "TSA" as used herein refers to a counter-structure that is present primarily on tumor cells of a mammalian subject but generally not found on normal cells of the mammalian subject. A tumor specific antigen need not be exclusive to tumor cells but the percentage of cells of a particular mammal that have the tumor specific antigen is sufficiently high or the levels of the tumor specific antigen on the surface of the tumor are sufficiently high such that it can be targeted by anti-tumor therapeutics, such as immunomodulatory polypeptides of the invention, and provide prevention or treatment of the mammal from the effects of the tumor. In some embodiments, in a random statistical sample of cells from a mammal with a tumor, at least 50% of the cells displaying a TSA are cancerous. In other embodiments, at least 60%, 70%, 80%, 85%, 90%, 95%, or 99% of the cells displaying a TSA are cancerous.

The term "variant" (also "modified" or mutant") as used in reference to a variant CD80 means a CD80, such as a mammalian (e.g., human or murine) CD80 created by human intervention. The variant CD80 is a polypeptide having an altered amino acid sequence, relative to an unmodified or wild-type CD80. The variant CD80 is a polypeptide which differs from a wild-type CD80 isoform sequence by one or more amino acid substitutions, deletions, additions, or combinations thereof. For purposes herein, the variant CD80 contains at least one affinity modified domain, whereby one or more of the amino acid differences occurs in an IgSF domain (e.g., IgV domain). A variant CD80 can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid differences, such as amino acid substitutions. A variant CD80 polypeptide generally exhibits at least 50%, 60%, 70%, 80%, 85%, 86%, 87%, 88%, 89%, 90%, 91%, 92%, 93%, 94%, 95%, 96%, 97%, 98%, 99% or more sequence identity to a corresponding wild-type or unmodified CD80, such as to the sequence of SEQ ID NO:1, a mature sequence thereof or a portion thereof containing the extracellular domain or an IgSF domain thereof. In some embodiments, a variant CD80 polypeptide exhibits at least 50%, 60%, 70%, 80%, 85%, 86%, 87%, 88%, 89%, 90%, 91%, 92%, 93%, 94%, 95%, 96%, 97%, 98%, 99% or more sequence identity to a corresponding wild-type or unmodified CD80 comprising the sequence set forth in SEQ ID NO: 2, SEQ ID NO: 76, or SEQ ID NO: 150, SEQ ID NO: 3030, or SEQ ID NO: 3031. [0224]. Non-naturally occurring amino acids as well as naturally occurring amino acids are included within the scope of permissible substitutions or additions. A variant CD80 is not limited to any particular method of making and includes, for example, de novo chemical synthesis, de novo recombinant DNA techniques, or combinations thereof. A variant CD80 of the invention specifically binds to at least one or more of: CD28, PD-L1 and/or CTLA-4 of a mammalian species. In some embodiments, the altered amino acid sequence results in an altered (i.e., increased or decreased) binding affinity or avidity to CD28, PD-L1 and/or CTLA-4 compared to the unmodified or wild-type CD80 protein. An increase or decrease in binding affinity or avidity can be determined using well known binding assays such as flow cytometry. Larsen et al., American Journal of Transplantation, Vol 5: 443-453 (2005). See also, Linsley et al., Immunity, Vol 1(9): 793-801 (1994). An increase in variant CD80 binding affinity or avidity to CD28, PD-L1 and/or CTLA-4 can be a value at least 5% greater than that of the unmodified or wild-type CD80 and in some embodiments, at least 10%, 15%, 20%, 30%, 40%, 50%, 100% greater than that of the unmodified or wild-type CD80 control value. A decrease in CD80 binding affinity or avidity to CD28, PD-L1 and/or CTLA-4 is to a value no greater than 95% of the of the unmodified or wild-type CD80 control values, and in some embodiments no greater than 80%, 70% 60%, 50%, 40%, 30%, 20%, 10%, 5%, or no detectable binding affinity or avidity of the unmodified or wild-type CD80 control values. A variant CD80 polypeptide is altered in primary amino acid sequence by substitution, addition, or deletion of amino acid residues. The term "variant" in the context of variant CD80 polypeptide is not to be construed as imposing any condition for any particular starting composition or method by which the variant CD80 is created. A variant CD80 can, for example, be generated starting from wild type mammalian CD80 sequence information, then modeled in silico for binding to CD28, PD-L1 and/or CTLA-4, and finally recombinantly or chemically synthesized to yield the variant CD80. In but one alternative example, the variant CD80 can be created by site-directed mutagenesis of an unmodified or wild-type CD80. Thus, variant CD80 denotes a composition and not necessarily a product produced by any given process. A variety of techniques including recombinant methods, chemical synthesis, or combinations thereof, may be employed.

The term "wild-type" or "natural" or "native" as used herein is used in connection with biological materials such as nucleic acid molecules, proteins (e.g., CD80), IgSF members, host cells, and the like, refers to those which are found in nature and not modified by human intervention.

II. Variant CD80 Polypeptides

Provided herein are variant CD80 polypeptides that exhibit altered (increased or decreased) binding activity or affinity for one or more CD80 binding partners. In some embodiments, the CD80 binding partner is CD28, PD-L1, or CTLA-4. In some embodiments, the variant CD80 polypeptide contains one or more amino acid modifications, such as one or more substitutions (alternatively, "mutations" or "replacements"), deletions or additions in an immunoglobulin superfamily (IgSF) domain (IgD) relative to a wild-type or unmodified CD80 polypeptide or a portion of a wild-type or unmodified CD80 containing the IgD or a specific binding fragment thereof. Thus, a provided variant CD80 polypeptide is or comprises a variant IgD (hereinafter called "vIgD") in which the one or more amino acid modifications (e.g., substitutions) is in an IgD.

In some embodiments, the IgD comprises an IgV domain or an IgC (e.g., IgC2) domain or specific binding fragment of the IgV domain or the IgC (e.g., IgC2) domain, or combinations thereof. In some embodiments, the IgD can be an IgV only, the combination of the IgV and IgC, including the entire extracellular domain (ECD), or any combination of Ig domains of CD80. Table 2 provides exemplary residues that correspond to IgV or IgC regions of CD80. In some embodiments, the variant CD80 polypeptide contains an IgV domain, or an IgC domain, or specific binding fragments thereof in which the at least one amino acid modification (e.g., substitution) in the IgV domain or IgC domain or the specific binding fragment thereof. In some embodiments, the variant CD80 polypeptide contains an IgV domain or specific binding fragments thereof in which the at least one of the amino acid modifications (e.g., substitutions) is in the IgV domain or a specific binding fragment thereof. In some embodiments, by virtue of the altered binding activity or affinity, the altered IgV domain or IgC domain is an affinity modified IgSF domain.

In some embodiments, the variant is modified in one more IgSF domains relative to the sequence of an unmodified CD80 sequence. In some embodiments, the unmodified CD80 sequence is a wild-type CD80. In some embodiments, the unmodified or wild-type CD80 has the sequence of a native CD80 or an ortholog thereof. In some embodiments, the unmodified CD80 is or comprises the extracellular domain (ECD) of CD80 or a portion thereof containing one or more IgSF domain (see Table 2). For example, an unmodified CD80 polypeptide is or comprises an IgV domain set forth as amino acids 35-135 of SEQ ID NO:1, amino acids 35-138 of SEQ ID NO: 1 (see SEQ ID NO:3030), or amino acids 35-141 of SEQ ID NO: 1. In some cases, an unmodified CD80 polypeptide is or comprises an IgC domain set forth as amino acids 145-230 of SEQ ID NO:1 or amino acids 142-232 of SEQ ID NO:1. In some embodiments, the extracellular domain of an unmodified or wild-type CD80 polypeptide comprises an IgV domain and an IgC domain or domains. However, the variant CD80 polypeptide need not comprise both the IgV domain and the IgC domain or domains. In some embodiments, the variant CD80 polypeptide comprises or consists essentially of the IgV domain or a specific binding fragment thereof. In some embodiments, the variant CD80 polypeptide comprises or consists essentially of the IgC domain or specific binding fragments thereof. In some embodiments, the variant CD80 is soluble and lacks a transmembrane domain. In some embodiments, the variant CD80 further comprises a transmembrane domain and, in some cases, also a cytoplasmic domain.

In some embodiments, the wild-type or unmodified CD80 polypeptide is a mammalian CD80 polypeptide, such as, but not limited to, a human, a mouse, a cynomolgus monkey, or a rat CD80 polypeptide. In some embodiments, the wild-type or unmodified CD80 sequence is human.

In some embodiments, the wild-type or unmodified CD80 polypeptide has (i) the sequence of amino acids set forth in SEQ ID NO: 1 or a mature form thereof lacking the signal sequence, (ii) a sequence of amino acids that exhibits at least about 85%, 86%, 87%, 88%, 89%, 90%, 91%, 92%, 93%, 94%, 95%, 96%, 97%, 98%, 99% sequence identity to SEQ ID NO: 1 or a mature form thereof, or (iii) is a portion of (i) or (ii) containing an IgV domain or IgC domain or specific binding fragments thereof.

In some embodiments, the wild-type or unmodified CD80 polypeptide is or comprises an extracellular domain of the CD80 or a portion thereof. For example, in some embodiments, the unmodified or wild-type CD80 polypeptide comprises the amino acid sequence set forth in SEQ ID NO: 2, or an ortholog thereof. For example, the unmodified or wild-type CD80 polypeptide can comprise (i) the sequence of amino acids set forth in SEQ ID NO:2, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 2, or (iii) is a specific binding fragment of (i) or (ii) comprising an IgV domain or an IgC domain. In some embodiments, the wild-type or unmodified extracellular domain of CD80 is capable of binding one or more CD80 binding proteins, such as one or more of CTLA-4, PD-L1 or CD28.

In some embodiments, the wild-type or unmodified CD80 polypeptide contains an IgV domain or an IgC domain, or a specific binding fragment thereof. In some embodiments, the IgV domain of the wild-type or unmodified CD80 polypeptide comprises the amino acid sequence set forth in SEQ ID NO: 76, 150, 3030, or 3031, or an ortholog thereof. For example, the IgV domain of the unmodified or wild-type CD80 polypeptide can contain (i) the sequence of amino acids set forth in SEQ ID NO: 76, 150, 3030, or 3031, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 76, 150, 3030, or 3031, or (iii) is a specific binding fragment of (i) or (ii). In some embodiments, the wild-type or unmodified IgV domain is capable of binding one or more CD80 binding proteins, such as one or more of CTLA-4, PD-L1 or CD28.

In some embodiments, the IgC domain of the wild-type or unmodified CD80 polypeptide comprises the amino acid sequence set forth as residues 145-230, 154-232, or 142-232 of SEQ ID NO: 1, or an ortholog thereof. For example, the IgC domain of the unmodified or wild-type CD80 polypeptide can contain (i) the sequence of amino acids set forth as residues 145-230, 154-232, or 142-232 of SEQ ID NO: 1, (ii) a sequence of amino acids that has at least about 85%, 86%, 87%, 88%, 89%, 90%, 91%, 92%, 93%, 94%, 95%, 96%, 97%, 98%, 99% sequence identity to residues 145-230, 154-232, or 142-232 of SEQ ID NO: 1, or (iii) is a specific binding fragment of (i) or (ii). In some embodiments, the wild-type or unmodified IgC domain is capable of binding one or more CD80 binding proteins.

In some embodiments, the wild-type or unmodified CD80 polypeptide contains a specific binding fragment of CD80, such as a specific binding fragment of the IgV domain or the IgC domain. In some embodiments the specific binding fragment can bind CTLA-4, PD-L1 and/or CD28. The specific binding fragment can have an amino acid length of at least 50 amino acids, such as at least 60, 70, 80, 90, 100, or 110 amino acids. In some embodiments, the specific binding fragment of the IgV domain contains an amino acid sequence that is at least about 85%, 86%, 87%, 88%, 89%, 90%, 91%, 92%, 93%, 94%, 95%, 96%, 97%, 98%, 99% of the length of the IgV domain set forth as amino acids 35-135, 35-138, 37-138 or 35-141 of SEQ ID NO: 1. In some embodiments, the specific binding fragment of the IgC domain comprises an amino acid sequence that is at least about 85%, 86%, 87%, 88%, 89%, 90%, 91%, 92%, 93%, 94%, 95%, 96%, 97%, 98%, 99% of the length of the IgC domain set forth as amino acids 145-230, 154-232, 142-232 of SEQ ID NO: 1.

In some embodiments, the variant CD80 polypeptide comprises the ECD domain or a portion thereof comprising one or more affinity modified IgSF domains. In some embodiments, the variant CD80 polypeptides can comprise an IgV domain or an IgC domain, or a specific binding fragment of the IgV domain or a specific binding fragment of the IgC domain in which at least one of the IgV or IgC domain contains the one or more amino acid modifications (e.g., substitutions). In some embodiments, the variant CD80 polypeptides can comprise an IgV domain and an IgC domain, or a specific binding fragment of the IgV domain and a specific binding fragment of the IgC domain. In some embodiments, the variant CD80 polypeptide comprises a full-length IgV domain. In some embodiments, the variant CD80 polypeptide comprises a full-length IgC domain. In some embodiments, the variant CD80 polypeptide comprises a specific binding fragment of the IgV domain. In some embodiments, the variant CD80 polypeptide comprises a specific binding fragment of the IgC domain. In some embodiments, the variant CD80 polypeptide comprises a full-length IgV domain and a full-length IgC domain. In some embodiments, the variant CD80 polypeptide comprises a full-length IgV domain and a specific binding fragment of an IgC domain. In some embodiments, the variant CD80 polypeptide comprises a specific binding fragment of an IgV domain and a full-length IgC domain. In some embodiments, the variant CD80 polypeptide comprises a specific binding fragment of an IgV domain and a specific binding fragment of an IgC domain.

In any of such embodiments, the one or more amino acid modifications (e.g., substitutions) of the variant CD80 polypeptides can be located in any one or more of the CD80 polypeptide domains. For example, in some embodiments, one or more amino acid modifications (e.g., substitutions) are located in the extracellular domain of the variant CD80 polypeptide. In some embodiments, one or more amino acid modifications (e.g., substitutions) are located in the IgV domain or specific binding fragment of the IgV domain. In some embodiments, one or more amino acid modifications (e.g., substitutions) are located in the IgC domain or specific binding fragment of the IgC domain.

Generally, each of the various attributes of polypeptides are separately disclosed below (e.g., soluble and membrane bound polypeptides, affinity of CD80 for CTLA-4, PD-L1, and CD28, number of variations per polypeptide chain, number of linked polypeptide chains, the number and nature of amino acid alterations per variant CD80, etc.). However, as will be clear to the skilled artisan, any particular polypeptide can comprise a combination of these independent attributes. It is understood that reference to amino acids, including to a specific sequence set forth as a SEQ ID NO used to describe domain organization of an IgSF domain are for illustrative purposes and are not meant to limit the scope of the embodiments provided. It is understood that polypeptides and the description of domains thereof are theoretically derived based on homology analysis and alignments with similar molecules. Thus, the exact locus can vary, and is not necessarily the same for each protein. Hence, the specific IgSF domain, such as specific IgV domain or IgC domain, can be several amino acids (such as one, two, three or four) longer or shorter.

Further, various embodiments of the invention as discussed below are frequently provided within the meaning of a defined term as disclosed above. The embodiments described in a particular definition are therefore to be interpreted as being incorporated by reference when the defined term is utilized in discussing the various aspects and attributes described herein. Thus, the headings, the order of presentation of the various aspects and embodiments, and the separate disclosure of each independent attribute is not meant to be a limitation to the scope of the present disclosure.

A. Exemplary Modifications

Provided herein are variant CD80 polypeptides containing at least one affinity-modified IgSF domain (e.g., IgV or IgC) or a specific binding fragment thereof relative to an IgSF domain contained in a wild-type or unmodified CD80 polypeptide such that the variant CD80 polypeptide exhibits altered (increased or decreased) binding activity or affinity for one or more cognate binding partners, CTLA-4, PD-L1, or CD28, compared to a wild-type or unmodified CD80 polypeptide. In some embodiments, a variant CD80 polypeptide has a binding affinity for CTLA-4, PD-L1, or CD28 that differs from that of a wild-type or unmodified CD80 polypeptide control sequence as determined by, for example, solid-phase ELISA immunoassays, flow cytometry or surface plasmon resonance (Biacore) assays. In some embodiments, the variant CD80 polypeptide has an increased binding affinity for CTLA-4, PD-L1, and/or CD28. In some embodiments, the variant CD80 polypeptide has a decreased binding affinity for CD28, PD-L1, and/or CTLA-4, relative to a wild-type or unmodified CD80 polypeptide. The CD28, PD-L1 and/or the CTLA-4 can be a mammalian protein, such as a human protein or a murine protein.

The altered, e.g. increased or decreased, binding activity or affinity for CTLA-4, PD-L1 and/or CD28 is conferred by one or more amino acid modifications in an IgSF domain of a wild-type or unmodified IgSF domain. The wild-type or unmodified CD80 sequence does not necessarily have to be used as a starting composition to generate variant CD80 polypeptides described herein. Therefore, use of the term "substitution" does not imply that the provided embodiments are limited to a particular method of making variant CD80 polypeptides. Variants CD80 polypeptides can be made, for example, by de novo peptide synthesis and thus does not necessarily require a "substitution" in the sense of altering a codon to encode for the substitution. This principle also extends to the terms "addition" and "deletion" of an amino acid residue which likewise do not imply a particular method of making. The means by which the variant CD80 polypeptides are designed or created is not limited to any particular method. In some embodiments, however, a wild-type or unmodified CD80 encoding nucleic acid is mutagenized from wild-type or unmodified CD80 genetic material and screened for desired specific binding affinity and/or induction of IFN-gamma expression or other functional activity according to the methods disclosed in the Examples or other methods known to a skilled artisan. In some embodiments, a variant CD80 polypeptide is synthesized de novo utilizing protein or nucleic acid sequences available at any number of publicly available databases and then subsequently screened. The National Center for Biotechnology Information provides such information and its website is publicly accessible via the internet as is the UniProtKB database as discussed previously.

Unless stated otherwise, as indicated throughout the present disclosure, the amino acid modifications(s) are designated by amino acid position number corresponding to the numbering of positions of the unmodified ECD sequence set forth in SEQ ID NO:2 or, where applicable, the unmodified IgV sequence set forth in SEQ ID NO:76, 150, 3030, or 3031 as follows:

```
                                        (SEQ ID NO: 2)
VIHVTKEVKEVATLSCGHNVSVEELAQTRIYWQKEKKMVLTMMSGDM

NIWPEYKNRTIFDITNNLSIVILALRPSDEGTYECVVLKYEKDAFKR

EHLAEVTLSVKADFPTPSISDFEIPTSNIRRIICSTSGGFPEPHLSW

LENGEELNAINTTVSQDPETELYAVSSKLDFNMTTNHSFMCLIKYGH

LRVNQTFNWNTTKQEHFPDN

                                        (SEQ ID NO: 76)
VIHVTKEVKEVATLSCGHNVSVEELAQTRIYWQKEKKMVLTMMSGDM

NIWPEYKNRTIFDITNNLSIVILALRPSDEGTYECVVLKYEKDAFKR

EHLAEVT

                                        (SEQ ID NO: 150)
VIHVTKEVKEVATLSCGHNVSVEELAQTRIYWQKEKKMVLTMMSGDM

NIWPEYKNRTIFDITNNLSIVIQALRPSDEGTYECVVLKYEKDGFKR

EHLAEVTLSVKAD

                                        (SEQ ID NO: 3030)
VIHVTKEVKEVATLSCGHNVSVEELAQTRIYWQKEKKMVLTMMSGDM

NIWPEYKNRTIFDITNNLSIVILALRPSDEGTYECVVLKYEKDAFKR

EHLAEVTLSV
```

-continued (SEQ ID NO: 3031)

VIHVTKEVKEVATLSCGHNVSVEELAQTRIYWQKEKKMVLTMMSGDM

NIWPEYKNRTIFDITNNLSIVILALRPSDEGTYECVVLKYEKDAFKR

EHLAEVTLSVKAD

It is within the level of a skilled artisan to identify the corresponding position of a modification, e.g., amino acid substitution, in a CD80 polypeptide, including portion thereof containing an IgSF domain (e.g., IgV) thereof, such as by alignment of a reference sequence with SEQ ID NO:2 or SEQ ID NO:76 or SEQ ID NO:150 or SEQ ID NO: 3030 or SEQ ID NO:3031. In the listing of modifications throughout this disclosure, the amino acid position is indicated in the middle, with the corresponding unmodified (e.g., wild-type) amino acid listed before the number and the identified variant amino acid substitution listed after the number. If the modification is a deletion of the position, a "del" is indicated, and if the modification is an insertion at the position, an "ins" is indicated. In some cases, an insertion is listed with the amino acid position indicated in the middle, with the corresponding unmodified (e.g., wild-type) amino acid listed before and after the number and the identified variant amino acid insertion listed after the unmodified (e.g., wild-type) amino acid.

In some embodiments, the variant CD80 polypeptide has one or more amino acid modifications (e.g., substitutions) in a wild-type or unmodified CD80 sequence. The one or more amino acid modifications (e.g., substitutions) can be in the ectodomain (extracellular domain) of the wild-type or unmodified CD80 sequence, such as the extracellular domain. In some embodiments, the one or more amino acid modifications (e.g., substitutions) are in the IgV domain or specific binding fragment thereof. In some embodiments, the one or more amino acid modifications (e.g., substitutions) are in the IgC domain or specific binding fragment thereof. In some embodiments of the variant CD80 polypeptide, some of the one or more amino acid modifications (e.g., substitutions) are in the IgV domain or a specific binding fragment thereof, and some of the one or more amino acid modifications (e.g., substitutions) are in the IgC domain or a specific binding fragment thereof.

In some embodiments, the variant CD80 polypeptide has up to 1, 2, 3, 4, 5, 6, 7, 8, 9, 10, 11, 12, 13, 14, 15, 16, 17, 18, 19, or 20 amino acid modifications (e.g., substitutions). The modifications (e.g., substitutions) can be in the IgV domain or the IgC domain. In some embodiments, the variant CD80 polypeptide has up to 1, 2, 3, 4, 5, 6, 7, 8, 9, 10, 11, 12, 13, 14, 15, 16, 17, 18, 19, or 20 amino acid modifications (e.g., substitutions) in the IgV domain or specific binding fragment thereof. In some embodiments, the variant CD80 polypeptide has up to 1, 2, 3, 4, 5, 6, 7, 8, 9, 10, 11, 12, 13, 14, 15, 16, 17, 18, 19, or 20 amino acid modifications (e.g., substitutions) in the IgC domain or specific binding fragment thereof. In some embodiments, the variant CD80 polypeptide has at least about 85%, 86%, 86%, 88%, 89%, 90%, 91%, 92%, 93%, 94%, 95%, 96%, 97%, 98%, or 99% sequence identity with the wild-type or unmodified CD80 polypeptide or specific binding fragment thereof, such as the amino acid sequence of SEQ ID NO: 2, 76, 150, 3030, or 3031.

In some embodiments, the variant CD80 polypeptide has one or more amino acid modifications (e.g., substitutions) in an unmodified CD80 or specific binding fragment there of corresponding to position(s) 7, 13, 15, 16, 20, 22, 23, 24, 25, 26, 27, 30, 31, 33, 34, 35, 36, 38, 41, 42, 43, 46, 47, 48, 51, 53, 54, 55, 57, 58, 61, 62, 65, 67, 68, 69, 70, 71, 72, 73, 74, 76, 77, 78, 79, 81, 82, 84, 85, 86, 87, 88, 92, 94, 95, and/or 97 with reference to numbering of SEQ ID NO: 2. In some embodiments, the variant CD80 polypeptide has one or more amino acid modifications (e.g., substitutions) in an unmodified CD80 or specific binding fragment there of corresponding to position(s) 7, 23, 26, 30, 34, 35, 46, 51, 55, 57, 58, 65, 71, 73, 78, 79, 82, or 84 with reference to numbering of SEQ ID NO: 2. In some embodiments, the variant CD80 polypeptide has a modification, e.g., amino acid substitution, at any 2 or more of the foregoing positions, such as 2, 3, 4, 5, 6, 7, 8, 9, 10, 11, 12, 13, 14, 15 or more of the positions.

In some embodiments, the variant CD80 polypeptide has one or more amino acid substitution selected from among E7D, T13A, T13R, S15P, S15T, C16R, H18A, H18C, H18F, H18I, H18T, H18V, V20A, V20I, V22D, V22I, V22L, E23D, E23G, E24D, L25S, A26D, A26E, A26G, A26H, A26K, A26N, A26P, A26Q, A26R, A26S, A26T, Q27H, Q27L, T28Y, I30F, I30T, I30V, Y31C, Y31S, Q33E, Q33K, Q33L, Q33R, K34E, E35D, E35G, K36R, T41S, M42I, M42V, M43L, M43T, D46E, D46N, D46V, M47F, M47I, M47L, M47V, M47Y, N48D, N48H, N48K, N48R, N48S, N48T, N48Y, P51A, Y53F, Y53H, K54E, K54N, K54R, N55D, N55I, T57A, T57I, I58V, I61F, I61V, T62A, T62N, N63D, L65P, I67L, I67V, V68E, V68I, V68L, I69F, L70M, L70P, L70Q, A71D, A71G, L72V, R73H, R73S, P74S, D76H, E77A, G78A, T79A, T79I, T79L, T79M, T79P, E81G, E81K, C82R, V84A, V84I, L85E, L85M, L85Q, K86M, Y87C, Y87D, Y87H, Y87Q, E88V, D90P, F92S, F92V, K93T, R94Q, R94W, E95D, E95V, L97M, and L97Q. In some embodiments, the variant CD80 polypeptide has one or more amino acid substitutions selected from E7D, E23D, E23G, A26E, A26P, A26S, A26T, I30F, I30T, I30V, K34E, E35D, E35G, D46E, D46V, P51A, N55D, N55I, T57A, T57I, I58V, L65P, A71D, A71G, R73S, G78A, T79A, T79I, T79L, T79P, C82R, V84A, V84I, L85Q, or a conservative amino acid substitution thereof. In some embodiments, the variant CD80 polypeptide comprises any 2 or more of the foregoing amino acid substitutions, such as 2, 3, 4, 5, 6, 7, 8, 9, 10, 11, 12, 13, 14, 15 or more of the amino acid substitutions. In some embodiments, the variant CD80 polypeptides comprises only one amino acid difference compared to the unmodified or wild-type CD80 polypeptide comprising only one of the foregoing amino acid substitutions.

In some embodiments, the variant CD80 polypeptide contains one or more additional amino acid modifications (e.g., substitutions) in an unmodified CD80 or specific binding fragment thereof corresponding to position(s) 12, 18, 29, 31, 37, 38, 41, 43, 44, 47, 61, 67, 68, 69, 70, 72, 77, 83, 88, 89, 90, 91, or 93 with reference to numbering of SEQ ID NO: 2. In some embodiments, the variant CD80 polypeptide has one or more additional amino acid substitution selected from among A12T, A12V, H18L, H18Y, R29H, Y31H, K37E, M38T, T41A, M43I, S44P, M47L, M47T, I67T, V68A, V68M, I69T, L70P, L70R, L70Q, L72P, E77G, V83A, V83I, E88D, K89E, K89N, D90G, D90N, A91T, K93R.

A conservative amino acid substitution is any amino acid that falls in the same class of amino acids as the substituted amino acids, other than the wild-type or unmodified amino acid. The classes of amino acids are aliphatic (glycine, alanine, valine, leucine, and isoleucine), hydroxyl or sulfur-containing (serine, cysteine, threonine, and methionine), cyclic (proline), aromatic (phenylalanine, tyrosine, tryptophan), basic (histidine, lysine, and arginine), and acidic/ amide (aspartate, glutamate, asparagine, and glutamine). Thus, for example, a conservative amino acid substitution of the A26E substitution includes A26D, A26N, and A26Q amino acid substitutions.

In some embodiments, the variant CD80 polypeptide comprises an amino acid modification in an unmodified CD80 or specific binding fragment thereof at a position corresponding to position 18, with reference to numbering of positions set forth in SEQ ID NO:2. In some embodiments, the amino acid modification is the amino acid substitution H18Y or a conservative amino acid substitution thereof. In some embodiments, the variant CD80 polypeptide further contains one or more amino acid modifications, e.g. amino acid substitutions, at one or more positions 26, 35, 46, 47, 68, 71, 85 or 90. In some embodiments, the one or more amino acid modification is one or more amino acid substitutions A26E, E35D, D46E, D46V, M47I, M47L, V68M, A71G, L85Q or D90G, or a conservative amino acid substitution thereof. In some embodiments, the variant CD80 polypeptide comprises the amino acid modifications H18Y/A26E, H18Y/E35D, H18Y/D46E, H18Y/D46V, H18Y/M47I, H18Y/M47L, H18Y/V68M, H18Y/A71G, H18Y/L85Q, H18Y/D90G. The variant CD80 polypeptide can provide further amino acid modifications in accord with the provided embodiments. Table 1 sets forth exemplary amino acid modifications and variant CD80 polypeptides as described.

In some embodiments, the variant CD80 polypeptide comprises an amino acid modification in an unmodified CD80 or specific binding fragment thereof at a position corresponding to position 26, with reference to numbering of positions set forth in SEQ ID NO:2. In some embodiments, the amino acid modification is the amino acid substitution A26E or a conservative amino acid substitution thereof. In some embodiments, the variant CD80 polypeptide further contains one or more amino acid modifications, e.g. amino acid substitutions, at one or more positions 18, 35, 46, 47, 68, 71, 85 or 90. In some embodiments, the one or more amino acid modification is one or more amino acid substitutions H18Y, E35D, D46E, D46V, M47I, M47L, V68M, A71G, L85Q or D90G, or a conservative amino acid substitution thereof. In some embodiments, the variant CD80 polypeptide comprises the amino acid modifications H18Y/A26E, A26E/E35D, A26E/D46E, A26E/D46V, A26E/M47I, A26E/M47L, A26E/V68M, A26E/A71G, A26E/L85Q, A26E/D90G. The variant CD80 polypeptide can include further amino acid modifications, such as any described herein, in accord with provided embodiments. Table 1 sets forth exemplary amino acid modifications and variant CD80 polypeptides as described.

In some embodiments, the variant CD80 polypeptide comprises an amino acid modification in an unmodified CD80 or specific binding fragment thereof at a position corresponding to position 35, with reference to numbering of positions set forth in SEQ ID NO:2. In some embodiments, the amino acid modification is the amino acid substitution E35D or a conservative amino acid substitution thereof. In some embodiments, the variant CD80 polypeptide further contains one or more amino acid modifications, e.g. amino acid substitutions, at one or more positions 18, 26, 46, 47, 68, 71, 85 or 90. In some embodiments, the one or more amino acid modification is one or more amino acid substitutions H18Y, A26E, D46E, D46V, M47I, M47L, V68M, A71G, L85Q or D90G, or a conservative amino acid substitution thereof. In some embodiments, the variant CD80 polypeptide comprises the amino acid modifications H18Y/E35D, A26E/E35D, E35D/D46E, E35D/D46V, E35D/M47I, E35D/M47L, E35D/V68M, E35D/A71G, E35D/L85Q, E35D/D90G. The variant CD80 polypeptide can include further amino acid modifications, such as any described herein, in accord with provided embodiments. Table 1 sets forth exemplary amino acid modifications and variant CD80 polypeptides as described. In some embodiments, the variant CD80 polypeptide comprises an amino acid modification in an unmodified CD80 or specific binding fragment thereof at a position corresponding to position 46, with reference to numbering of positions set forth in SEQ ID NO:2. In some embodiments, the amino acid modification is the amino acid substitution D46E or D46V or a conservative amino acid substitution thereof. In some embodiments, the variant CD80 polypeptide further contains one or more amino acid modifications, e.g. amino acid substitutions, at one or more positions 18, 26, 35, 47, 68, 71, 85 or 90. In some embodiments, the one or more amino acid modification is one or more amino acid substitutions H18Y, A26E, E35D, M47I, M47L, V68M, A71G, L85Q or D90G, or a conservative amino acid substitution thereof. In some embodiments, the variant CD80 polypeptide comprises the amino acid modifications H18Y/D46E, A26E/D46E, E35D/D46E, D46E/M47I, D46E/M47L, D46E/V68M, D46E/A71G, D46E/L85Q, D46E/D90G. In some embodiments, the variant CD80 polypeptide comprises the amino acid modifications H18Y/D46V, A26E/D46V, E35D/D46V, D46V/M47I, D46V/M47L, D46V/V68M, D46V/A71G, D46V/L85Q, D46V/D90G. The variant CD80 polypeptide can include further amino acid modifications, such as any described herein, in accord with provided embodiments. Table 1 sets forth exemplary amino acid modifications and variant CD80 polypeptides as described.

In some embodiments, the variant CD80 polypeptide comprises an amino acid modification in an unmodified CD80 or specific binding fragment thereof at a position corresponding to position 47, with reference to numbering of positions set forth in SEQ ID NO:2. In some embodiments, the amino acid modification is the amino acid substitution M47I or M47L or a conservative amino acid substitution thereof. In some embodiments, the variant CD80 polypeptide further contains one or more amino acid modifications, e.g. amino acid substitutions, at one or more positions 18, 26, 35, 46, 68, 71, 85 or 90. In some embodiments, the one or more amino acid modification is one or more amino acid substitutions H18Y, A26E, E35D, D46E, D46V, V68M, A71G, L85Q or D90G, or a conservative amino acid substitution thereof. In some embodiments, the variant CD80 polypeptide comprises the amino acid modifications H18Y/M47I, A26E/M47I, E35D/M47I, M47I/D46E, M47I/D46V, M47I/V68M, M47I/A71G, M47I/L85Q or M47I/D90G. In some embodiments, the variant CD80 polypeptide comprises the amino acid modifications H18Y/M47L, A26E/M47L, E35D/M47L, M47L/D46E, M47L/D46V, M47L/V68M, M47L/A71G, M47L/L85Q, or M47L/D90G. The variant CD80 polypeptide can include further amino acid modifications, such as any described herein, in accord with provided embodiments. Table 1 sets forth exemplary amino acid modifications and variant CD80 polypeptides as described.

In some embodiments, the variant CD80 polypeptide comprises an amino acid modification in an unmodified CD80 or specific binding fragment thereof at a position corresponding to position 68, with reference to numbering of positions set forth in SEQ ID NO:2. In some embodiments, the amino acid modification is the amino acid substitution V68M or a conservative amino acid substitution thereof. In some embodiments, the variant CD80 polypeptide further contains one or more amino acid modifications, e.g. amino acid substitutions, at one or more positions 18, 26, 35, 46, 47, 71, 85 or 90. In some embodiments, the one or more amino acid modification is one or more amino acid substitutions H18Y, A26E, E35D, D46E, D46V, M47I, M47L, A71G, L85Q or D90G, or a conservative amino acid substitution thereof. In some embodiments, the variant CD80 polypeptide comprises the amino acid modifications H18Y/V68M, A26E/V68M, E35D/V68M, D46E/V68M, D46V/D68M, M47I/V68M, M47L/V68M, V68M/A71G, V68M/L85Q, V68M/D90G. The variant CD80 polypeptide can include further amino acid modifications, such as any described herein, in accord with provided embodiments. Table 1 sets forth exemplary amino acid modifications and variant CD80 polypeptides as described.

In some embodiments, the variant CD80 polypeptide comprises an amino acid modification in an unmodified CD80 or specific binding fragment thereof at a position corresponding to position 71, with reference to numbering of positions set forth in SEQ ID NO:2. In some embodiments, the amino acid modification is the amino acid substitution A71G or a conservative amino acid substitution thereof. In some embodiments, the variant CD80 polypeptide further contains one or more amino acid modifications, e.g. amino acid substitutions, at one or more positions 18, 26, 35, 46, 47, 68, 85 or 90. In some embodiments, the one or more amino acid modification is one or more amino acid substitutions H18Y, A26E, E35D, D46E, D46V, M47I, M47L, V68M, L85Q or D90G, or a conservative amino acid substitution thereof. In some embodiments, the variant CD80 polypeptide comprises the amino acid modifications H18Y/A71G, A26E/A71G, E35D/A71G, D46E/A71G, D46V/D68M, M47I/A71G, M47L/A71G, V68M/A71G, A71G/L85Q, A71G/D90G. The variant CD80 polypeptide can include further amino acid modifications, such as any described herein, in accord with provided embodiments. Table 1 sets forth exemplary amino acid modifications and variant CD80 polypeptides as described.

In some embodiments, the variant CD80 polypeptide comprises an amino acid modification in an unmodified CD80 or specific binding fragment thereof at a position corresponding to position 85, with reference to numbering of positions set forth in SEQ ID NO:2. In some embodiments, the amino acid modification is the amino acid substitution L85Q or a conservative amino acid substitution thereof. In some embodiments, the variant CD80 polypeptide further contains one or more amino acid modifications, e.g. amino acid substitutions, at one or more positions 18, 26, 35, 46, 47, 68, 71, or 90. In some embodiments, the one or more amino acid modification is one or more amino acid substitutions H18Y, A26E, E35D, D46E, D46V, M47I, M47L, V68M, A71G or D90G, or a conservative amino acid substitution thereof. In some embodiments, the variant CD80 polypeptide comprises the amino acid modifications H18Y/L85Q, A26E/L85Q, E35D/L85Q, D46E/L85Q, D46V/D68M, M47I/L85Q, M47L/L85Q, V68M/L85Q, A71G/L85Q, L85Q/D90G. The variant CD80 polypeptide can include further amino acid modifications, such as any described herein, in accord with provided embodiments. Table 1 sets forth exemplary amino acid modifications and variant CD80 polypeptides as described.

In some embodiments, the variant CD80 polypeptide comprises an amino acid modification in an unmodified CD80 or specific binding fragment thereof at a position corresponding to position 90, with reference to numbering of positions set forth in SEQ ID NO:2. In some embodiments, the amino acid modification is the amino acid substitution D90G or a conservative amino acid substitution thereof. In some embodiments, the variant CD80 polypeptide further contains one or more amino acid modifications, e.g. amino acid substitutions, at one or more positions 18, 26, 35, 46, 47, 68, 71, or 85. In some embodiments, the one or more amino acid modification is one or more amino acid substitutions H18Y, A26E, E35D, D46E, D46V, M47I, M47L, V68M, A71G or L85Q, or a conservative amino acid substitution thereof. In some embodiments, the variant CD80 polypeptide comprises the amino acid modifications H18Y/D90G, A26E/D90G, E35D/D90G, D46E/D90G, D46V/D68M, M47I/D90G, M47L/D90G, V68M/D90G, A71G/D90G, L85Q/D90G. The variant CD80 polypeptide can include further amino acid modifications, such as any described herein, in accord with provided embodiments. Table 1 sets forth exemplary amino acid modifications and variant CD80 polypeptides as described.

In some embodiments, the variant CD80 polypeptide does not contain amino acid modifications in an unmodified CD80 polypeptide set forth in SEQ ID NO:2, 76 or 150 in which the only amino acid modifications are H18Y/M47I/T57I/A71G, H18Y/A26T/E35D/A71D/L85Q or H18Y/A71D/L72P/E88V. In some embodiments, the variant CD80 polypeptide is not the polypeptide set forth in SEQ ID NO: 41, 59, 66, 115, 133, 140, 189, 207 or 214.

In some embodiments, the variant CD80 polypeptide does not contain amino acid modifications in an unmodified CD80 polypeptide set forth in SEQ ID NO:2, 76 or 150 in which the only amino acid modifications are A26E/E35D/M47L/L85Q. In some embodiments, the variant CD80 polypeptide is not the polypeptide set forth in SEQ ID NO: 73, 147, or 221.

In some embodiments, the variant CD80 polypeptide does not contain amino acid modifications in an unmodified CD80 polypeptide set forth in SEQ ID NO:2, 76 or 150 in which the only amino acid modifications are E35D/M47I/L65P/D90N, L25S/E35D/M47I/D90N, E35D/A71D, E35D/M47I, E35D/T57I/L70Q/A71D, E35D/A71D, E35D/167L/A71D. E35D, E35D/M47I/L70M, E35D/A71D/L72V, E35D/M43L/L70M, A26P/E35D/M43I/L85Q/E88D, E35D/D46V/L85Q, Q27L/E35D/M47I/T57I/L70Q/E88D, E35D/T57A/A71D/L85Q, H18Y/A26T/E35D/A71D/L85Q, E35D/M47L, E35D/M43I/A71D, E23G/A26S/E35D/T62N/A71D/L72V/L85M, A12T/E24D/E35D/D46V/I61V/L72P/E95V, V22L/E35D/M43L/A71G/D76H, A26E/E35D/M47L/L85Q, Y31H/E35D/T41S/V68L/K93R/R94W. In some embodiments, the variant CD80 polypeptide is not the polypeptide set forth in SEQ ID NO: 19, 20, 28, 29, 37, 46, 47, 50, 51, 52, 53, 54, 55, 56, 58, 59, 60, 64, 68, 69, 70, 73, 75, 93, 94, 102, 103, 111, 120, 121, 124, 125, 126, 127, 128, 129, 130, 132, 133, 134, 138, 142, 143, 144, 147, 149, 167, 168, 176, 177, 185, 194, 195, 198, 199, 200, 201, 202, 203, 204, 206, 207, 208, 212, 216, 217, 218, 221, or 223.

In some embodiments, the variant CD80 polypeptide does not contain amino acid modifications in an unmodified CD80 polypeptide set forth in SEQ ID NO:2, 76 or 150 in which the only amino acid modifications are E35D/D46V/L85Q, A12T/E24D/E35D/D46V/I61V/L72P/E95V or D46E/A71D. In some embodiments, the variant CD80 polypeptide is not the polypeptide set forth in SEQ ID NO: 55, 69, 74, 129, 143, 148, 203, 217, or 222.

In some embodiments, the variant CD80 polypeptide does not contain amino acid modifications in an unmodified CD80 polypeptide set forth in SEQ ID NO:2, 76 or 150 in which the only amino acid modifications are E35D/M47I/L65P/D90N, L25S/E35D/M47I/D90N, E35D/M47I, M47L/V68A, M47I/E88D, H18Y/M47I/T57I/A71G, T13R/M42V/

M47I/A71D, E35D/M47I/L70M, Q27L/E35D/M47I/T57I/L70Q/E88D, E35D/M47L, A26E/E35D/M47L/L85Q. In some embodiments, the variant CD80 polypeptide is not the polypeptide set forth in SEQ ID NO: 19, 20, 29, 33, 38, 41, 49, 51, 56, 60, 73, 93, 94, 103, 107, 112, 115, 123, 125, 130, 134, 147, 167, 168, 177, 181, 186, 189, 197, 199, 204, 208, 221.

In some embodiments, the variant CD80 polypeptide does not contain amino acid modifications in an unmodified CD80 polypeptide set forth in SEQ ID NO:2, 76 or 150 in which the only amino acid modifications are A26E/E35D/M47L/L85Q. In some embodiments, the variant CD80 polypeptide is not the polypeptide set forth in SEQ ID NO: 62, 136, 210.

In some embodiments, the variant CD80 polypeptide does not contain amino acid modifications in an unmodified CD80 polypeptide set forth in SEQ ID NO:2, 76 or 150 in which the only amino acid modifications are H18Y/M47I/T57I/A71G or V22L/E35D/M43L/A71G/D76H. In some embodiments, the variant CD80 polypeptide is not the polypeptide set forth in SEQ ID NO: 41, 70, 115, 144, 189 or 218.

In some embodiments, the variant CD80 polypeptide does not contain amino acid modifications in an unmodified CD80 polypeptide set forth in SEQ ID NO:2, 76 or 150 in which the only amino acid modifications are A26P/E35D/M43I/L85Q/E88D, E35D/D46V/L85Q, E35D/T57A/A71D/L85Q, H18Y/A26T/E35D/A71D/L85Q or A26E/E35D/M47L/L85Q. In some embodiments, the variant CD80 polypeptide is not the polypeptide set forth in SEQ ID NO: 54, 55, 58, 59, 73, 128, 129, 132, 133, 147, 202, 203, 206, 207 or 221.

In some embodiments, the variant CD80 polypeptide comprises amino acid modifications in an unmodified CD80 or specific binding fragment thereof at a position corresponding to E35D and M47L. In some embodiments, the variant CD80 polypeptide comprises amino acid modifications in an unmodified CD80 or specific binding fragment thereof corresponding to E35D and M47I. In some embodiments, the variant CD80 polypeptide comprises amino acid modifications in an unmodified CD80 or specific binding fragment thereof corresponding to E35D and A71G. In some embodiments, the variant CD80 polypeptide comprises amino acid modifications in an unmodified CD80 or specific binding fragment thereof corresponding to E35D and M47V. In some embodiments, the variant CD80 polypeptide comprises amino acid modifications in an unmodified CD80 or specific binding fragment thereof corresponding to E35D and V68M. In some embodiments, the variant CD80 polypeptide comprises amino acid modifications in an unmodified CD80 or specific binding fragment thereof corresponding to H18Y and E35D.

In some embodiments, the variant CD80 polypeptide comprises at least three amino acid modifications, wherein the at least three modifications include a modification at three or more of positions corresponding to positions 18, 26, 35, 46, 47, 68, 71, 85 or 90, with reference to numbering of positions set forth in SEQ ID NO:2. In some embodiments, the at least three amino acid modification comprises amino acid modifications in an unmodified CD80 or specific binding fragment thereof corresponding to H18Y, A26E, E35D, D46E, D46V, M47I, M47L, V68M, A71G, L85Q, or D90G or a conservative amino acid substitution thereof.

In some embodiments, the variant CD80 polypeptide comprises amino acid modifications in an unmodified CD80 or specific binding fragment thereof corresponding to E35D/M47L/V68M.

In some embodiments, the variant CD80 polypeptide comprises amino acid modifications in an unmodified CD80 or specific binding fragment thereof corresponding to E35D/M47V/V68M.

In some embodiments, the variant CD80 polypeptide comprises amino acid modifications in an unmodified CD80 or specific binding fragment thereof corresponding to E35D/M47L/L85Q.

In some embodiments, the variant CD80 polypeptide comprises amino acid modifications in an unmodified CD80 or specific binding fragment thereof corresponding to H18Y/E35D/M47I.

In some embodiments, the variant CD80 polypeptide comprises any of the substitutions (mutations) listed in Table 1. Table 1 also provides exemplary sequences by reference to SEQ ID NO for the extracellular domain (ECD) or IgV domain of wild-type CD80 or exemplary variant CD80 polypeptides. As indicated, the exact locus or residues corresponding to a given domain can vary, such as depending on the methods used to identify or classify the domain. Also, in some cases, adjacent N- and/or C-terminal amino acids of a given domain (e.g., IgV) also can be included in a sequence of a variant IgSF polypeptide, such as to ensure proper folding of the domain when expressed. Thus, it is understood that the exemplification of the SEQ ID NOs in Table 1 is not to be construed as limiting. For example, the particular domain, such as the IgV domain, of a variant CD80 polypeptide can be several amino acids longer or shorter, such as 1-10, e.g., 1, 2, 3, 4, 5, 6 or 7 amino acids longer or shorter, than the sequence of amino acids set forth in the respective SEQ ID NO.

In some embodiments, the variant CD80 polypeptide comprises any of the extracellular domain (ECD) sequences listed in Table 1 (i.e., any one of SEQ ID NOS: 3-75, 2009-2104, 2297-2507, 2930-2960). In some embodiments, the variant CD80 polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the extracellular domain (ECD) sequences listed in Table 1 (i.e., any one of SEQ ID NOS: 3-75, 2009-2104, 2297-2507, 2930-2960) and contains the amino acid modification(s), e.g., substitution(s), not present in the wild-type or unmodified CD80. In some embodiments, the variant CD80 polypeptide comprises a specific binding fragment of any of the extracellular domain (ECD) sequences listed in Table 1 (i.e., any one of SEQ ID NOS: 3-75, 2009-2104, 2297-2507, 2930-2960) and contains the amino acid modification(s), e.g., substitution(s), not present in the wild-type or unmodified CD80. In some embodiments, the variant CD80 polypeptide comprises any of the IgV sequences listed in Table 1 (i.e., any one of SEQ ID NOS: 77-149, 151-223, 2105-2296, 2508-2929, 2961-3022). In some embodiments, the variant CD80 polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the IgV sequences listed in Table 1 (i.e., any one of SEQ ID NOS: 77-149, 151-223, 2105-2296, 2508-2929, 2961-3022) and contains the amino acid modification(s), e.g., substitution(s), not present in the wild-type or unmodified CD80. In some embodiments, the variant CD80 polypeptide comprises a specific binding fragment of any of the IgV sequences listed in Table 1 (i.e., any one of SEQ ID NOS: 77-149, 151-223, 2105-2296, 2508-2929, 2961-3022) and contains the amino acid modification(s), e.g., substitution(s), not present in the wild-type or unmodified CD80.

Table 1 also provides exemplary sequences by reference to SEQ ID NO for the extracellular domain (ECD) or IgV domain of wild-type CD80 or exemplary variant CD80 polypeptides. As indicated, the exact locus or residues corresponding to a given domain can vary, such as depending on the methods used to identify or classify the domain. Also, in some cases, adjacent N- and/or C-terminal amino acids of a given domain (e.g., ECD) also can be included in a sequence of a variant IgSF polypeptide, such as to ensure proper folding of the domain when expressed. Thus, it is understood that the exemplification of the SEQ ID NOS in Table 1 is not to be construed as limiting. For example, the particular domain, such as the IgV domain, of a variant CD80 polypeptide can be several amino acids longer or shorter, such as 1-10, e.g., 1, 2, 3, 4, 5, 6 or 7, amino acids longer or shorter, than the sequence of amino acids set forth in the respective SEQ ID NO.

TABLE 1

Exemplary variant CD80 polypeptides

| CD80 Mutation(s) | ECD SEQ ID NO | IgV SEQ ID NO | |
|---|---|---|---|
| Wild-type | 2 | 76 | 3031 |
| L70P | 3 | 77 | 151 |
| I30F/L70P | 4 | 78 | 152 |
| Q27H/T41S/A71D | 5 | 79 | 153 |
| I30T/L70R | 6 | 80 | 154 |
| T13R/C16R/L70Q/A71D | 7 | 81 | 155 |
| T57I | 8 | 82 | 156 |
| M43I/C82R | 9 | 83 | 157 |
| V22L/M38V/M47T/A71D/L85M | 10 | 84 | 158 |
| I30V/T57I/L70P/A71D/A91T | 11 | 85 | 159 |
| V22I/L70M/A71D | 12 | 86 | 160 |
| N55D/L70P/E77G | 13 | 87 | 161 |
| T57A/I69T | 14 | 88 | 162 |
| N55D/K86M | 15 | 89 | 163 |
| L72P/T79I | 16 | 90 | 164 |
| L70P/F92S | 17 | 91 | 165 |
| T79P | 18 | 92 | 166 |
| E35D/M47I/L65P/D90N | 19 | 93 | 167 |
| L25S/E35D/M47I/D90N | 20 | 94 | 168 |
| A71D | 22 | 96 | 170 |
| E81K/A91S | 24 | 98 | 172 |
| A12V/M47V/L70M | 25 | 99 | 173 |
| K34E/T41A/L72V | 26 | 100 | 174 |
| T41S/A71D/V84A | 27 | 101 | 175 |
| E35D/A71D | 28 | 102 | 176 |
| E35D/M47I | 29 | 103 | 177 |
| K36R/G78A | 30 | 104 | 178 |
| Q33E/T41A | 31 | 105 | 179 |
| M47V/N48H | 32 | 106 | 180 |
| M47L/V68A | 33 | 107 | 181 |
| S44P/A71D | 34 | 108 | 182 |
| Q27H/M43I/A71D/R73S | 35 | 109 | 183 |
| E35D/T57I/L70Q/A71D | 37 | 111 | 185 |
| M47I/E88D | 38 | 112 | 186 |
| M42I/I61V/A71D | 39 | 113 | 187 |
| P51A/A71D | 40 | 114 | 188 |
| H18Y/M47I/T57I/A71G | 41 | 115 | 189 |
| V20I/M47V/T57I/V84I | 42 | 116 | 190 |
| V20I/M47V/A71D | 43 | 117 | 191 |
| A71D/L72V/E95K | 44 | 118 | 192 |
| V22L/E35G/A71D/L72P | 45 | 119 | 193 |
| E35D/A71D | 46 | 120 | 194 |
| E35D/I67L/A71D | 47 | 121 | 195 |
| Q27H/E35G/A71D/L72P/T79I | 48 | 122 | 196 |
| T13R/M42V/M47I/A71D | 49 | 123 | 197 |
| E35D | 50 | 124 | 198 |
| E35D/M47I/L70M | 51 | 125 | 199 |
| E35D/A71D/L72V | 52 | 126 | 200 |
| E35D/M43L/L70M | 53 | 127 | 201 |
| A26P/E35D/M43I/L85Q/E88D | 54 | 128 | 202 |
| E35D/D46V/L85Q | 55 | 129 | 203 |
| Q27L/E35D/M47I/T57I/L70Q/E88D | 56 | 130 | 204 |
| M47V/I69F/A71D/V83I | 57 | 131 | 205 |
| E35D/T57A/A71D/L85Q | 58 | 132 | 206 |
| H18Y/A26I/E35D/A71D/L85Q | 59 | 133 | 207 |
| E35D/M47L | 60 | 134 | 208 |
| E23D/M42V/M43I/I58V/L70R | 61 | 135 | 209 |
| V68M/L70M/A71D/E95K | 62 | 136 | 210 |
| N55I/T57I/I69F | 63 | 137 | 211 |
| E35D/M43I/A71D | 64 | 138 | 212 |
| T41S/T57I/L70R | 65 | 139 | 213 |
| H18Y/A71D/L72P/E88V | 66 | 140 | 214 |

TABLE 1-continued

Exemplary variant CD80 polypeptides

| CD80 Mutation(s) | ECD SEQ ID NO | IgV SEQ ID NO | |
|---|---|---|---|
| V20I/A71D | 67 | 141 | 215 |
| E23G/A26S/E35D/T62N/A71D/L72V/L85M | 68 | 142 | 216 |
| A12T/E24D/E35D/D46V/I61V/L72P/E95V | 69 | 143 | 217 |
| V22L/E35D/M43L/A71G/D76H | 70 | 144 | 218 |
| E35G/K54E/A71D/L72P | 71 | 145 | 219 |
| L70Q/A71D | 72 | 146 | 220 |
| A26E/E35D/M47L/L85Q | 73 | 147 | 221 |
| D46E/A71D | 74 | 148 | 222 |
| Y31H/E35D/T41S/V68L/K93R/R94W | 75 | 149 | 223 |
| A26E/Q33R/E35D/M47L/L85Q/K86E | 2009 | 2105 | 2201 |
| A26E/Q33R/E35D/M47L/L85Q | 2010 | 2106 | 2202 |
| E35D/M47L/L85Q | 2011 | 2107 | 2203 |
| A26E/Q33L/E35D/M47L/L85Q | 2012 | 2108 | 2204 |
| A26E/Q33L/E35D/M47L | 2013 | 2109 | 2205 |
| H18Y/A26E/Q33L/E35D/M47L/L85Q | 2014 | 2110 | 2206 |
| Q33L/E35D/M47I | 2015 | 2111 | 2207 |
| H18Y/Q33L/E35D/M47I | 2016 | 2112 | 2208 |
| Q33L/E35D/D46E/M47I | 2017 | 2113 | 2209 |
| Q33R/E35D/D46E/M47I | 2018 | 2114 | 2210 |
| H18Y/E35D/M47L | 2019 | 2115 | 2211 |
| Q33L/E35D/M47V | 2020 | 2116 | 2212 |
| Q33L/E35D/M47V/T79A | 2021 | 2117 | 2213 |
| Q33L/E35D/T41S/M47V | 2022 | 2118 | 2214 |
| Q33L/E35D/M47I/L85Q | 2023 | 2119 | 2215 |
| Q33L/E35D/M47I/T62N/L85Q | 2024 | 2120 | 2216 |
| Q33L/E35D/M47V/L85Q | 2025 | 2121 | 2217 |
| A26E/E35D/M43T/M47L/L85Q/R94Q | 2026 | 2122 | 2218 |
| Q33R/E35D/K37E/M47V/L85Q | 2027 | 2123 | 2219 |
| V22A/E23D/Q33L/E35D/M47V | 2028 | 2124 | 2220 |
| E24D/Q33L/E35D/M47V/K54R/L85Q | 2029 | 2125 | 2221 |
| S15P/Q33L/E35D/M47L/L85Q | 2030 | 2126 | 2222 |
| E7D/E35D/M47I/L97Q | 2031 | 2127 | 2223 |
| Q33L/E35D/T41S/M43I | 2032 | 2128 | 2224 |
| E35D/M47I/K54R/L85E | 2033 | 2129 | 2225 |
| Q33K/E35D/D46V/L85Q | 2034 | 2130 | 2226 |
| Y31S/E35D/M47L/T79L/E88G | 2035 | 2131 | 2227 |
| H18L/V22A/E35D/M47L/N48T/L85Q | 2036 | 2132 | 2228 |
| Q27H/E35D/M47L/L85Q/R94Q/E95K | 2037 | 2133 | 2229 |
| Q33K/E35D/M47V/K89E/K93R | 2038 | 2134 | 2230 |
| E35D/M47I/E77A/L85Q/R94W | 2039 | 2135 | 2231 |
| A26E/E35D/M43I/M47L/L85Q/K86E/R94W | 2040 | 2136 | 2232 |
| Q27H/Q33L/E35D/M47V/N55D/L85Q/K89N | 2041 | 2137 | 2233 |
| H18Y/V20A/Q33L/E35D/M47V/Y53F | 2042 | 2138 | 2234 |
| V22A/E35D/V68E/A71D | 2043 | 2139 | 2235 |
| Q33L/E35D/M47L/A71G/F92S | 2044 | 2140 | 2236 |
| V22A/R29H/E35D/D46E/M47I | 2045 | 2141 | 2237 |
| Q33L/E35D/M43I/L85Q/R94W | 2046 | 2142 | 2238 |
| H18Y/E35D/V68M/L97Q | 2047 | 2143 | 2239 |
| Q33L/E35D/M47L/V68M/L85Q/E88D | 2048 | 2144 | 2240 |
| Q33L/E35D/M43V/M47I/A71G | 2049 | 2145 | 2241 |
| E35D/M47L/A71G/L97Q | 2050 | 2146 | 2242 |
| E35D/M47V/A71G/L85M/L97Q | 2051 | 2147 | 2243 |
| H18Y/Y31H/E35D/M47V/A71G/L85Q | 2052 | 2148 | 2244 |
| E35D/D46E/M47V/L97Q | 2053 | 2149 | 2245 |
| E35D/D46V/M47I/A71G/F92V | 2054 | 2150 | 2246 |
| E35D/M47V/T62A/A71G/V83A/Y87H/L97M | 2055 | 2151 | 2247 |
| Q33L/E35D/N48K/L85Q/L97Q | 2056 | 2152 | 2248 |
| E35D/L85Q/K93T/E95V/L97Q | 2057 | 2153 | 2249 |
| E35D/M47V/N48K/V68M/K89N | 2058 | 2154 | 2250 |
| Q33L/E35D/M47I/N48D/A71G | 2059 | 2155 | 2251 |
| R29H/E35D/M43V/M47I/I49V | 2060 | 2156 | 2252 |
| Q27H/E35D/M47I/L85Q/D90G | 2061 | 2157 | 2253 |
| E35D/M47I/L85Q/D90G | 2062 | 2158 | 2254 |
| E35D/M47I/T62S/L85Q | 2063 | 2159 | 2255 |
| A26E/E35D/M47L/A71G | 2064 | 2160 | 2256 |
| E35D/M47I/Y87Q/K89E | 2065 | 2161 | 2257 |
| V22A/E35D/M47I/Y87N | 2066 | 2162 | 2258 |
| H18Y/A26E/E35D/M47L/L85Q/D90G | 2067 | 2163 | 2259 |
| E35D/M47L/A71G/L85Q | 2068 | 2164 | 2260 |
| E35D/M47V/A71G/E88D | 2069 | 2165 | 2261 |
| E35D/A71G | 2070 | 2166 | 2262 |
| E35D/M47V/A71G | 2071 | 2167 | 2263 |
| I30V/E35D/M47V/A71G/A91V | 2072 | 2168 | 2264 |
| I30V/Y31C/E35D/M47V/A71G/L85M | 2073 | 2169 | 2265 |
| V22D/E35D/M47L/L85Q | 2074 | 2170 | 2266 |

TABLE 1-continued

Exemplary variant CD80 polypeptides

| CD80 Mutation(s) | ECD SEQ ID NO | IgV SEQ ID NO | |
|---|---|---|---|
| H18Y/E35D/N48K | 2075 | 2171 | 2267 |
| E35D/T41S/M47V/A71G/K89N | 2076 | 2172 | 2268 |
| E35D/M47V/N48T/L85Q | 2077 | 2173 | 2269 |
| E35D/D46E/M47V/A71D/D90G | 2078 | 2174 | 2270 |
| E35D/D46E/M47V/A71D | 2079 | 2175 | 2271 |
| E35D/T41S/M43I/A71G/D90G | 2080 | 2176 | 2272 |
| E35D/T41S/M43I/M47V/A71G | 2081 | 2177 | 2273 |
| E35D/T41S/M43I/M47L/A71G | 2082 | 2178 | 2274 |
| H18Y/V22A/E35D/M47V/T62S/A71G | 2083 | 2179 | 2275 |
| H18Y/A26E/E35D/M47L/V68M/A71G/D90G | 2084 | 2180 | 2276 |
| E35D/K37E/M47V/N48D/L85Q/D90N | 2085 | 2181 | 2277 |
| Q27H/E35D/D46V/M47L/A71G | 2086 | 2182 | 2278 |
| V22L/Q27H/E35D/M47I/A71G | 2087 | 2183 | 2279 |
| E35D/D46V/M47L/V68M/L85Q/E88D | 2088 | 2184 | 2280 |
| E35D/T41S/M43V/M47I/L70M/A71G | 2089 | 2185 | 2281 |
| E35D/D46E/M47V/N63D/L85Q | 2090 | 2186 | 2282 |
| E35D/M47V/T62A/A71D/K93E | 2091 | 2187 | 2283 |
| E35D/D46E/M47V/V68M/D90G/K93E | 2092 | 2188 | 2284 |
| E35D/M43I/M47V/K89N | 2093 | 2189 | 2285 |
| E35D/M47L/A71G/L85M/F92Y | 2094 | 2190 | 2286 |
| E35D/M42V/M47V/E52D/L85Q | 2095 | 2191 | 2287 |
| V22D/E35D/M47L/L70M/L97Q | 2096 | 2192 | 2288 |
| E35D/T41S/M47V/L97Q | 2097 | 2193 | 2289 |
| E35D/Y53H/A71G/D90G/L97R | 2098 | 2194 | 2290 |
| E35D/A71D/L72V/R73H/E81K | 2099 | 2195 | 2291 |
| Q33L/E35D/M43I/Y53F/T62S/L85Q | 2100 | 2196 | 2292 |
| E35D/M38T/D46E/M47V/N48S | 2101 | 2197 | 2293 |
| Q33R/E35D/M47V/N48K/L85M/F92L | 2102 | 2198 | 2294 |
| E35D/M38T/M43V/M47V/N48R/L85Q | 2103 | 2199 | 2295 |
| T28Y/Q33H/E35D/D46V/M47I/A71G | 2104 | 2200 | 2296 |
| E35D/N48K/L72V | 2297 | 2508 | 2719 |
| E35D/T41S/N48T | 2298 | 2509 | 2720 |
| D46V/M47I/A71G | 2299 | 2510 | 2721 |
| M47I/A71G | 2300 | 2511 | 2722 |
| E35D/M43I/M47L/L85M | 2301 | 2512 | 2723 |
| E35D/M43I/D46E/A71G/L85M | 2302 | 2513 | 2724 |
| H18Y/E35D/M47L/A71G/A91S | 2303 | 2514 | 2725 |
| E35D/M47I/N48K/I61F | 2304 | 2515 | 2726 |
| E35D/M47V/T62S/L85Q | 2305 | 2516 | 2727 |
| M43I/M47L/A71G | 2306 | 2517 | 2728 |
| E35D/M47V | 2307 | 2518 | 2729 |
| E35D/M47L/A71G/L85M | 2308 | 2519 | 2730 |
| V22A/E35D/M47L/A71G | 2309 | 2520 | 2731 |
| E35D/M47L/A71G | 2310 | 2521 | 2732 |
| E35D/D46E/M47I | 2311 | 2522 | 2733 |
| Q27H/E35D/M47I | 2312 | 2523 | 2734 |
| E35D/D46E/L85M | 2313 | 2524 | 2735 |
| E35D/D46E/A91G | 2314 | 2525 | 2736 |
| E35D/D46E | 2315 | 2526 | 2737 |
| E35D/L97R | 2316 | 2527 | 2738 |
| H18Y/E35D | 2317 | 2528 | 2739 |
| Q27L/E35D/M47V/I61V/L85M | 2318 | 2529 | 2740 |
| E35D/M47V/I61V/L85M | 2319 | 2530 | 2741 |
| E35D/M47V/L85M/R94Q | 2320 | 2531 | 2742 |
| E35D/M47V/N48K/L85M | 2321 | 2532 | 2743 |
| H18Y/E35D/M47V/N48K | 2322 | 2533 | 2744 |
| A26E/Q27R/E35D/M47L/N48Y/L85Q | 2323 | 2534 | 2745 |
| E35D/D46E/M47L/V68M/L85Q/F92L | 2324 | 2535 | 2746 |
| E35D/M47I/T62S/L85Q/E88D | 2325 | 2536 | 2747 |
| E24D/Q27R/E35D/T41S/M47V/L85Q | 2326 | 2537 | 2748 |
| S15T/H18Y/E35D/M47V/T62A/N64S/A71G/L85Q/D90N | 2327 | 2538 | 2749 |
| E35D/M47L/V68M/A71G/L85Q/D90G | 2328 | 2539 | 2750 |
| H18Y/E35D/M47I/V68M/A71G/R94L | 2329 | 2540 | 2751 |
| deltaE10-A98 | 2330 | 2541 | 2752 |
| Q33R/M47V/T62N/A71G | 2331 | 2542 | 2753 |
| H18Y/V22A/E35D/T41S/M47V/T62N/A71G/A91G | 2332 | 2543 | 2754 |
| E35D/M47L/L70M | 2333 | 2544 | 2755 |
| E35D/M47L/V68M | 2334 | 2545 | 2756 |
| E35D/D46V/M47L/V68M/E88D | 2335 | 2546 | 2757 |
| E35D/D46V/M47L/V68M/D90G | 2336 | 2547 | 2758 |
| E35D/D46V/M47L/V68M/K89N | 2337 | 2548 | 2759 |
| E35D/D46V/M47L/V68M/L85Q | 2338 | 2549 | 2760 |
| E35D/D46V/M47L/V68M | 2339 | 2550 | 2761 |
| E35D/D46V/M47L/V70M | 2340 | 2551 | 2762 |
| E35D/D46V/M47L/V70M/L85Q | 2341 | 2552 | 2763 |

TABLE 1-continued

| Exemplary variant CD80 polypeptides | | | |
|---|---|---|---|
| CD80 Mutation(s) | ECD SEQ ID NO | IgV SEQ ID NO | |
| E35D/M47V/N48K/V68M | 2342 | 2553 | 2764 |
| E24D/E35D/M47L/V68M/E95V/L97Q | 2343 | 2554 | 2765 |
| E35D/D46E/M47I/T62A/V68M/L85M/Y87C | 2344 | 2555 | 2766 |
| E35D/D46E/M47I/V68M/L85M | 2345 | 2556 | 2767 |
| E35D/D46E/M47L/V68M/A71G/Y87C/K93R | 2346 | 2557 | 2768 |
| E35D/D46E/M47L/V68M/T79M/L85M | 2347 | 2558 | 2769 |
| E35D/D46E/M47L/V68M/T79M/L85M/L97Q | 2348 | 2559 | 2770 |
| E35D/D46E/M47V/V68M/L85Q | 2349 | 2560 | 2771 |
| E35D/M43I/M47L/V68M | 2350 | 2561 | 2772 |
| E35D/M47I/V68M/Y87N | 2351 | 2562 | 2773 |
| E35D/M47L/V68M/E95V/L97Q | 2352 | 2563 | 2774 |
| E35D/M47L/Y53F/V68M/A71G/K93R/E95V | 2353 | 2564 | 2775 |
| E35D/M47V/N48K/V68M/A71G/L85M | 2354 | 2565 | 2776 |
| E35D/M47V/N48K/V68M/L85M | 2355 | 2566 | 2777 |
| E35D/M47V/V68M/L85M | 2356 | 2567 | 2778 |
| E35D/M47V/V68M/L85M/Y87D | 2357 | 2568 | 2779 |
| E35D/T41S/D46E/M47I/V68M/K93R/E95V | 2358 | 2569 | 2780 |
| H18Y/E35D/D46E/M47I/V68M/R94L | 2359 | 2570 | 2781 |
| H18Y/E35D/M38I/M47L/V68M/L85M | 2360 | 2571 | 2782 |
| H18Y/E35D/M47I/V68M/Y87N | 2361 | 2572 | 2783 |
| H18Y/E35D/M47L/V68M/A71G/L85M | 2362 | 2573 | 2784 |
| H18Y/E35D/M47L/V68M/E95V/L97Q | 2363 | 2574 | 2785 |
| H18Y/E35D/M47L/Y53F/V68M/A71G | 2364 | 2575 | 2786 |
| H18Y/E35D/M47L/Y53F/V68M/A71G/K93R/E95V | 2365 | 2576 | 2787 |
| H18Y/E35D/M47V/V68M/L85M | 2366 | 2577 | 2788 |
| H18Y/E35D/V68M/A71G/R94Q/E95V | 2367 | 2578 | 2789 |
| H18Y/E35D/V68M/L85M/R94Q | 2368 | 2579 | 2790 |
| H18Y/E35D/V68M/T79M/L85M | 2369 | 2580 | 2791 |
| H18Y/V22D/E35D/M47V/N48K/V68M | 2370 | 2581 | 2792 |
| Q27L/Q33L/E35D/T41S/M47V/N48K/V68M/L85M | 2371 | 2582 | 2793 |
| Q33L/E35D/M47V/T62S/V68M/L85M | 2372 | 2583 | 2794 |
| Q33R/E35D/M38I/M47L/V68M | 2373 | 2584 | 2795 |
| R29C/E35D/M47L/V68M/A71G/L85M | 2374 | 2585 | 2796 |
| S21P/E35D/K37E/D46E/M47I/V68M | 2375 | 2586 | 2797 |
| S21P/E35D/K37E/D46E/M47I/V68M/R94L | 2376 | 2587 | 2798 |
| T13R/E35D/M47L/V68M | 2377 | 2588 | 2799 |
| T13R/H18Y/E35D/V68M/L85M/R94Q | 2378 | 2589 | 2800 |
| T13R/Q27L/Q33L/E35D/T41S/M47V/N48K/V68M/L85M | 2379 | 2590 | 2801 |
| T13R/Q33L/E35D/M47L/V68M/L85M | 2380 | 2591 | 2802 |
| T13R/Q33L/E35D/M47V/T62S/V68M/L85M | 2381 | 2592 | 2803 |
| T13R/Q33R/E35D/M38I/M47L/V68M | 2382 | 2593 | 2804 |
| T13R/Q33R/E35D/M38I/M47L/V68M/E95V/L97Q | 2383 | 2594 | 2805 |
| T13R/Q33R/E35D/M38I/M47L/V68M/L85M | 2384 | 2595 | 2806 |
| T13R/Q33R/E35D/M38I/M47L/V68M/L85M/R94Q | 2385 | 2596 | 2807 |
| T13R/Q33R/E35D/M47L/V68M | 2386 | 2597 | 2808 |
| T13R/Q33R/E35D/M47L/V68M/L85M | 2387 | 2598 | 2809 |
| V22D/E24D/E35D/M47L/V68M | 2388 | 2599 | 2810 |
| V22D/E24D/E35D/M47L/V68M/L85M/D90G | 2389 | 2600 | 2811 |
| V22D/E24D/E35D/M47V/V68M | 2390 | 2601 | 2812 |
| D46V | 2391 | 2602 | 2813 |
| M47L | 2392 | 2603 | 2814 |
| V68M | 2393 | 2604 | 2815 |
| L85Q | 2394 | 2605 | 2816 |
| E35D/D46V | 2395 | 2606 | 2817 |
| E35D/V68M | 2396 | 2607 | 2818 |
| E35D/L85Q | 2397 | 2608 | 2819 |
| D46V/M47L | 2398 | 2609 | 2820 |
| D46V/V68M | 2399 | 2610 | 2821 |
| D46V/L85Q | 2400 | 2611 | 2822 |
| M47L/V68M | 2401 | 2612 | 2823 |
| M47L/L85Q | 2402 | 2613 | 2824 |
| V68M/L85Q | 2403 | 2614 | 2825 |
| E35D/D46V/M47L | 2404 | 2615 | 2826 |
| E35D/D46V/V68M | 2405 | 2616 | 2827 |
| E35D/D46V/L85Q | 2406 | 2617 | 2828 |
| E35D/V68M/L85Q | 2407 | 2618 | 2829 |
| D46V/M47L/V68M | 2408 | 2619 | 2830 |
| D46V/M47L/L85Q | 2409 | 2620 | 2831 |
| D46V/V68M/L85Q | 2410 | 2621 | 2832 |
| M47L/V68M/L85Q | 2411 | 2622 | 2833 |
| E35D/D46V/M47L/L85Q | 2412 | 2623 | 2834 |
| E35D/D46V/V68M/L85Q | 2413 | 2624 | 2835 |
| E35D/M47L/V68M/L85Q | 2414 | 2625 | 2836 |
| D46V/M47L/V68M/L85Q | 2415 | 2626 | 2837 |
| M47V | 2416 | 2627 | 2838 |

TABLE 1-continued

Exemplary variant CD80 polypeptides

| CD80 Mutation(s) | ECD SEQ ID NO | IgV SEQ ID NO | |
|---|---|---|---|
| N48K | 2417 | 2628 | 2839 |
| K89N | 2418 | 2629 | 2840 |
| E35D/N48K | 2419 | 2630 | 2841 |
| E35D/K89N | 2420 | 2631 | 2842 |
| M47V/N48K | 2421 | 2632 | 2843 |
| M47V/V68M | 2422 | 2633 | 2844 |
| M47V/K89N | 2423 | 2634 | 2845 |
| N48K/V68M | 2424 | 2635 | 2846 |
| N48K/K89N | 2425 | 2636 | 2847 |
| V68M/K89N | 2426 | 2637 | 2848 |
| E35D/M47V/N48K | 2427 | 2638 | 2849 |
| E35D/M47V/V68M | 2428 | 2639 | 2850 |
| E35D/M47V/K89N | 2429 | 2640 | 2851 |
| E35D/N48K/V68M | 2430 | 2641 | 2852 |
| E35D/N48K/K89N | 2431 | 2642 | 2853 |
| E35D/V68M/K89N | 2432 | 2643 | 2854 |
| M47V/N48K/V68M | 2433 | 2644 | 2855 |
| M47V/N48K/K89N | 2434 | 2645 | 2856 |
| M47V/V68M/K89N | 2435 | 2646 | 2857 |
| N48K/V68M/K89N | 2436 | 2647 | 2858 |
| E35D/M47V/N48K/K89N | 2437 | 2648 | 2859 |
| E35D/M47V/V68M/K89N | 2438 | 2649 | 2860 |
| E35D/N48K/V68M/K89N | 2439 | 2650 | 2861 |
| M47V/N48K/V68M/K89N | 2440 | 2651 | 2862 |
| E35D/D46V/M47V/N48K/V68M | 2441 | 2652 | 2863 |
| E35D/D46V/M47V/V68M/L85Q | 2442 | 2653 | 2864 |
| E35D/D46V/M47V/V68M/K89N | 2443 | 2654 | 2865 |
| E35D/M47V/N48K/V68M/L85Q | 2444 | 2655 | 2866 |
| E35D/M47V/V68M/L85Q/K89N | 2445 | 2656 | 2867 |
| A26E/E35D/M47L/V68M/A71G/D90G | 2446 | 2657 | 2868 |
| H18Y/E35D/M47L/V68M/A71G/D90G | 2447 | 2658 | 2869 |
| H18Y/A26E/M47L/V68M/A71G/D90G | 2448 | 2659 | 2870 |
| H18Y/A26E/E35D/V68M/A71G/D90G | 2449 | 2660 | 2871 |
| H18Y/A26E/E35D/M47L/A71G/D90G | 2450 | 2661 | 2872 |
| H18Y/A26E/E35D/M47L/V68M/D90G | 2451 | 2662 | 2873 |
| H18Y/A26E/E35D/M47L/V68M/A71G | 2452 | 2663 | 2874 |
| E35D/M47L/V68M/A71G/D90G | 2453 | 2664 | 2875 |
| H18Y/M47L/V68M/A71G/D90G | 2454 | 2665 | 2876 |
| H18Y/A26E/V68M/A71G/D90G | 2455 | 2666 | 2877 |
| H18Y/A26E/E35D/A71G/D90G | 2456 | 2667 | 2878 |
| H18Y/A26E/E35D/M47L/D90G | 2457 | 2668 | 2879 |
| H18Y/A26E/E35D/M47L/V68M | 2458 | 2669 | 2880 |
| A26E/M47L/V68M/A71G/D90G | 2459 | 2670 | 2881 |
| A26E/E35D/V68M/A71G/D90G | 2460 | 2671 | 2882 |
| A26E/E35D/M47L/A71G/D90G | 2461 | 2672 | 2883 |
| A26E/E35D/M47L/V68M/D90G | 2462 | 2673 | 2884 |
| A26E/E35D/M47L/V68M/A71G | 2463 | 2674 | 2885 |
| H18Y/E35D/V68M/A71G/D90G | 2464 | 2675 | 2886 |
| H18Y/E35D/M47L/A71G/D90G | 2465 | 2676 | 2887 |
| H18Y/E35D/M47L/V68M/D90G | 2466 | 2677 | 2888 |
| H18Y/E35D/M47L/V68M/A71G | 2467 | 2678 | 2889 |
| H18Y/A26E/M47L/A71G/D90G | 2468 | 2679 | 2890 |
| H18Y/A26E/M47L/V68M/D90G | 2469 | 2680 | 2891 |
| H18Y/A26E/M47L/V68M/A71G | 2470 | 2681 | 2892 |
| H18Y/A26E/E35D/V68M/D90G | 2471 | 2682 | 2893 |
| H18Y/A26E/E35D/V68M/A71G | 2472 | 2683 | 2894 |
| H18Y/A26E/E35D/M47L/A71G | 2473 | 2684 | 2895 |
| M47L/V68M/A71G/D90G | 2474 | 2685 | 2896 |
| H18Y/V68M/A71G/D90G | 2475 | 2686 | 2897 |
| H18Y/A26E/A71G/D90G | 2476 | 2687 | 2898 |
| H18Y/A26E/E35D/D90G | 2477 | 2688 | 2899 |
| H18Y/A26E/E35D/M47L | 2478 | 2689 | 2900 |
| E35D/V68M/A71G/D90G | 2479 | 2690 | 2901 |
| E35D/M47L/A71G/D90G | 2480 | 2691 | 2902 |
| E35D/M47L/V68M/D90G | 2481 | 2692 | 2903 |
| E35D/M47L/V68M/A71G | 2482 | 2693 | 2904 |
| A26E/V68M/A71G/D90G | 2483 | 2694 | 2905 |
| A26E/M47L/A71G/D90G | 2484 | 2695 | 2906 |
| A26E/M47L/V68M/D90G | 2485 | 2696 | 2907 |
| A26E/M47L/V68M/A71G | 2486 | 2697 | 2908 |
| A26E/E35D/A71G/D90G | 2487 | 2698 | 2909 |
| A26E/E35D/V68M/D90G | 2488 | 2699 | 2910 |
| A26E/E35D/V68M/A71G | 2489 | 2700 | 2911 |
| A26E/E35D/M47L/D90G | 2490 | 2701 | 2912 |
| A26E/E35D/M47L/V68M | 2491 | 2702 | 2913 |

TABLE 1-continued

Exemplary variant CD80 polypeptides

| CD80 Mutation(s) | ECD SEQ ID NO | IgV SEQ ID NO | |
|---|---|---|---|
| H18Y/M47L/A71G/D90G | 2492 | 2703 | 2914 |
| H18Y/M47L/V68M/D90G | 2493 | 2704 | 2915 |
| H18Y/M47L/V68M/A71G | 2494 | 2705 | 2916 |
| H18Y/E35D/A71G/D90G | 2495 | 2706 | 2917 |
| H18Y/E35D/V68M/D90G | 2496 | 2707 | 2918 |
| H18Y/E35D/V68M/A71G | 2497 | 2708 | 2919 |
| H18Y/E35D/M47L/D90G | 2498 | 2709 | 2920 |
| H18Y/E35D/M47L/A71G | 2499 | 2710 | 2921 |
| H18Y/E35D/M47L/V68M | 2500 | 2711 | 2922 |
| H18Y/A26E/V68M/D90G | 2501 | 2712 | 2923 |
| H18Y/A26E/V68M/A71G | 2502 | 2713 | 2924 |
| H18Y/A26E/M47L/D90G | 2503 | 2714 | 2925 |
| H18Y/A26E/M47L/A71G | 2504 | 2715 | 2926 |
| H18Y/A26E/M47L/V68M | 2505 | 2716 | 2927 |
| H18Y/A26E/E35D/A71G | 2506 | 2717 | 2928 |
| H18Y/A26E/E35D/V68M | 2507 | 2718 | 2929 |
| H18Y/E35D/M47V/V68M/A71G | 2930 | 2961 | 2992 |
| H18C/A26P/E35D/M47L/V68M/A71G | 2931 | 2962 | 2993 |
| H18I/A26P/E35D/M47V/V68M/A71G | 2932 | 2963 | 2994 |
| H18L/A26N/D46E/V68M/A71G/D90G | 2933 | 2964 | 2995 |
| H18L/E35D/M47V/V68M/A71G/D90G | 2934 | 2965 | 2996 |
| H18T/A26N/E35D/M47L/V68M/A71G | 2935 | 2966 | 2997 |
| H18V/A26K/E35D/M47L/V68M/A71G | 2936 | 2967 | 2998 |
| H18V/A26N/E35D/M47V/V68M/A71G | 2937 | 2968 | 2999 |
| H18V/A26P/E35D/M47V/V68L/A71G | 2938 | 2969 | 3000 |
| H18V/A26P/E35D/M47L/V68M/A71G | 2939 | 2970 | 3001 |
| H18V/E35D/M47V/V68M/A71G/D90G | 2940 | 2971 | 3002 |
| H18Y/A26P/E35D/M47I/V68M/A71G | 2941 | 2972 | 3003 |
| H18Y/A26P/E35D/M47V/V68M/A71G | 2942 | 2973 | 3004 |
| H18Y/E35D/M47V/V68L/A71G/D90G | 2943 | 2974 | 3005 |
| H18Y/E35D/M47V/V68M/A71G/D90G | 2944 | 2975 | 3006 |
| A26P/E35D/M47I/V68M/A71G/D90G | 2945 | 2976 | 3007 |
| H18V/A26G/E35D/M47V/V68M/A71G/D90G | 2946 | 2977 | 3008 |
| H18V/A26S/E35D/M47L/V68M/A71G/D90G | 2947 | 2978 | 3009 |
| H18V/A26R/E35D/M47L/V68M/A71G/D90G | 2948 | 2979 | 3010 |
| H18V/A26D/E35D/M47V/V68M/A71G/D90G | 2949 | 2980 | 3011 |
| H18V/A26Q/E35D/M47V/V68L/A71G/D90G | 2950 | 2981 | 3012 |
| H18A/A26P/E35D/M47L/V68M/A71G/D90G | 2951 | 2982 | 3013 |
| H18A/A26N/E35D/M47L/V68M/A71G/D90G | 2952 | 2983 | 3014 |
| H18F/A26P/E35D/M47I/V68M/A71G/D90G | 2953 | 2984 | 3015 |
| H18F/A26H/E35D/M47L/V68M/A71G/D90G | 2954 | 2985 | 3016 |
| H18F/A26N/E35D/M47V/V68M/A71G/D90K | 2955 | 2986 | 3017 |
| H18Y/A26N/E35D/M47F/V68M/A71G/D90G | 2956 | 2987 | 3018 |
| H18Y/A26P/E35D/M47Y/V68I/A71G/D90G | 2957 | 2988 | 3019 |
| H18Y/A26Q/E35D/M47T/V68M/A71G/D90G | 2958 | 2989 | 3020 |
| H18R/A26P/E35D/D46N/M47V/V68M/A71G/D90P | 2959 | 2990 | 3021 |
| H18F/A26D/E35D/D46E/M47T/V68M/A71G/D90G | 2960 | 2991 | 3022 |

In some embodiments, the one or more amino acid modifications of a variant CD80 polypeptides provided herein produces at least one affinity-modified IgSF domain (e.g., IgV or IgC) or a specific binding fragment thereof relative to an IgSF domain contained in a wild-type or unmodified CD80 polypeptide such that the variant CD80 polypeptide exhibits altered (increased or decreased) binding activity or affinity for one or more binding partners, CTLA-4, PD-L1, or CD28, compared to a wild-type or unmodified CD80 polypeptide. In some embodiments, a variant CD80 polypeptide has a binding affinity for CTLA-4, PD-L1, or CD28 that differs from that of a wild-type or unmodified CD80 polypeptide control sequence as determined by, for example, solid-phase ELISA immunoassays, flow cytometry or surface plasmon resonance (Biacore) assays. In some embodiments, the variant CD80 polypeptide has an increased binding affinity for CTLA-4, PD-L1, and/or CD28. In some embodiments, the variant CD80 polypeptide has a decreased binding affinity for CD28, PD-L1, and/or CTLA-4, relative to a wild-type or unmodified CD80 polypeptide. The CD28, PD-L1 and/or the CTLA-4 can be a mammalian protein, such as a human protein or a murine protein.

Binding affinities for each of the binding partners are independent; that is, in some embodiments, a variant CD80 polypeptide has an increased binding affinity for one, two or three of CD28, PD-L1, and CTLA-4, and/or a decreased binding affinity for one, two or three of CD28, PD-L1, and CTLA-4, relative to a wild-type or unmodified CD80 polypeptide.

In some embodiments, the variant CD80 polypeptide has an increased binding affinity for CTLA-4, relative to a wild-type or unmodified CD80 polypeptide. In some embodiments, the variant CD80 polypeptide has an increased binding affinity for PD-L1, relative to a wild-type or unmodified CD80 polypeptide. In some embodiments, the variant CD80 polypeptide has an increased binding affinity for CD28, relative to a wild-type or unmodified CD80 polypeptide. In some embodiments, the variant CD80 polypeptide has a decreased binding affinity for CD28, relative to a wild-type or unmodified CD80 polypeptide. In some embodiments, the variant CD80 polypeptide has a decreased binding affinity for PD-L1, relative to a wild-type or unmodified CD80 polypeptide. In some embodiments, the variant CD80 polypeptide has a decreased binding affinity for CTLA-4, relative to a wild-type or unmodified CD80 polypeptide.

In some embodiments, the variant CD80 polypeptide has an increased binding affinity for CTLA-4 and PD-L1, relative to a wild-type or unmodified CD80 polypeptide. In some embodiments, the variant CD80 polypeptide has an increased binding affinity for CTLA-4 and a decreased binding affinity for PD-L1, relative to a wild-type or unmodified CD80 polypeptide. In some embodiments, the variant CD80 polypeptide has a decreased binding affinity for CTLA-4 and PD-L1, relative to a wild-type or unmodified CD80 polypeptide. In some embodiments, the variant CD80 polypeptide has a decreased binding affinity for CTLA-4 and an increased binding affinity for PD-L1, relative to a wild-type or unmodified CD80 polypeptide.

In some embodiments, the variant CD80 polypeptide has an increased binding affinity for CTLA-4 and CD28, relative to a wild-type or unmodified CD80 polypeptide. In some embodiments, the variant CD80 polypeptide has an increased binding affinity for CTLA-4 and a decreased binding affinity for CD28, relative to a wild-type or unmodified CD80 polypeptide. In some embodiments, the variant CD80 polypeptide has a decreased binding affinity for CTLA-4 and CD28, relative to a wild-type or unmodified CD80 polypeptide. In these embodiments, the In some embodiments, the variant CD80 polypeptide has an increased binding affinity for PD-L1 and CD28, relative to a wild-type or unmodified CD80 polypeptide. In some embodiments, the variant CD80 polypeptide has an increased binding affinity for PD-L1 and a decreased binding affinity for CD28, relative to a wild-type or unmodified CD80 polypeptide. In some embodiments, the variant CD80 polypeptide has a decreased binding affinity for PD-L1 and CD28, relative to a wild-type or unmodified CD80 polypeptide. In some embodiments, the variant CD80 polypeptide has a decreased binding affinity for PD-L1 and an increased binding affinity for CD28, relative to a wild-type or unmodified CD80 polypeptide.

In some embodiments, the variant CD80 polypeptide exhibits binding affinity to the ectodomain of human CTLA-4 which is no higher than the binding affinity of the unmodified or wild-type CD80 for the ectodomain of human CTLA-4.

In some embodiments, the variant CD80 polypeptide has an increased binding affinity for CTLA-4, PD-L1, and CD28, relative to a wild-type or unmodified CD80 polypeptide. In some embodiments, the variant CD80 polypeptide has an increased binding affinity for CTLA-4 and PD-L1, and a decreased binding affinity for CD28, relative to a wild-type or unmodified CD80 polypeptide. In some embodiments, the variant CD80 polypeptide has an increased binding affinity for CTLA-4 and CD28, and a decreased binding affinity for PD-L1, relative to a wild-type or unmodified CD80 polypeptide. In some embodiments, the variant CD80 polypeptide has a decreased binding affinity for CTLA-4 and PD-L1, and an increased binding affinity for CD28, relative to a wild-type or unmodified CD80 polypeptide. In some embodiments, the variant CD80 polypeptide has a decreased binding affinity for CTLA-4 and an increased binding affinity for PD-L1 and CD28, relative to a wild-type or unmodified CD80 polypeptide. In some embodiments, the variant CD80 polypeptide has an increased binding affinity for CTLA-4, and a decreased binding affinity for PD-L1 and CD28, relative to a wild-type or unmodified CD80 polypeptide. In some embodiments, the variant CD80 polypeptide has a decreased binding affinity for CTLA-4, PD-L1, and CD28, relative to a wild-type or unmodified CD80 polypeptide. In some embodiments, the variant CD80 polypeptide has a decreased binding affinity for CTLA-4, and an increased binding affinity for PD-L1 and CD-28, relative to a wild-type or unmodified CD80 polypeptide.

In some embodiments, a variant CD80 polypeptide with increased or greater binding affinity to CD28, PD-L1, and/or CTLA-4 will have an increase in binding affinity relative to the wild-type or unmodified CD80 polypeptide control of at least about 5%, such as at least about 10%, 15%, 20%, 25%, 35%, or 50% for the CTLA-4, PD-L1 and/or CD28 binding partner(s). In some embodiments, the increase in binding affinity relative to the wild-type or unmodified CD80 polypeptide is more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 150-fold, 200-fold, 250-fold, 300-fold, 350-fold, 400-fold, or more. In such examples, the wild-type or unmodified CD80 polypeptide has the same sequence as the variant CD80 polypeptide except that it does not contain the one or more amino acid modifications (e.g., substitutions).

In some embodiments, a variant CD80 polypeptide with decreased or reduced binding affinity to CTLA-4, PD-L1, and/or CD28 will have decrease in binding affinity relative to the wild-type or unmodified CD80 polypeptide control of at least 5%, such as at least about 10%, 15%, 20%, 30%, 40%, 50%, 60%, 70%, 80%, 90% or more for the CTLA-4, PD-L1, and/or CD28. In some embodiments, the decrease in binding affinity relative to the wild-type or unmodified CD80 polypeptide is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In such examples, the wild-type or unmodified CD80 polypeptide has the same sequence as the variant CD80 polypeptide except that it does not contain the one or more amino acid modifications (e.g., substitutions).

In some embodiments, the equilibrium dissociation constant ($K_d$) of any of the foregoing embodiments to CTLA-4, PD-L1, and/or CD28 can be at least $1\times10^{-5}$ M, $1\times10^{-6}$ M, $1\times10^{-7}$ M, $1\times10^{-8}$ M, $1\times10^{-9}$ M, $1\times10^{-10}$ M or $1\times10^{-11}$ M, or $1\times10^{-12}$ M.

In some embodiments, the provided variant CD80 polypeptides containing at least one affinity-modified IgSF domain (e.g., IgV or IgC) or a specific binding fragment thereof relative to an IgSF domain contained in a wild-type or unmodified CD80 polypeptide exhibit altered (increases/stimulates or decreases/inhibits) signaling induced by one or more functional binding partner(s), such as CTLA-4 or CD28, expressed on the surface of a cell capable of signaling, such as a T-cell capable of releasing cytokine in response to intracellular signal, compared to a wild-type or unmodified CD80 polypeptide upon binding the one or more binding partner(s). In some embodiments, the altered signaling differs from that effected by a wild-type or unmodified CD80 polypeptide control sequence, in the same format, as determined by, for example, an assay that measures cytokine release (e.g., IL-2 release), following incubation with the specified variant and/or wild-type or unmodified CD80 polypeptide. An exemplary assay is described in Examples 8-10. In exemplary assays, the cytokine release is a function of the sum of the signaling activities of the functional binding partners expressed on the surface of the cytokine-releasing cell. As discussed elsewhere herein, in some embodiments, the format of the provided variant CD80 polypeptides can impact the type of activity, e.g. agonist or antagonist.

Because CTLA-4 induces inhibitory signaling, increased CTLA-4 signaling results in a decrease in cytokine release in some exemplary assays. Conversely, decreased CTLA-4 signaling results in decreased inhibitory signaling, which does not decrease cytokine release and can result in increased cytokine release in some assays. Because CD28 signaling stimulates cytokine release, increased CD28 signaling results in increased cytokine release in exemplary assays. Conversely, decreased CD28 signaling results in decreased cytokine release in exemplary assays.

In some embodiments, the variant CD80 polypeptide increases CTLA-4, PD-L1, and/or CD28-mediated signaling. In some embodiments, the variant CD80 polypeptide decreases CD28, PD-L1, and/or CTLA-4-mediated signaling, relative to a wild-type or unmodified CD80 polypeptide.

Binding affinities for each of the cognate binding partners are independent; thus, in some embodiments, a variant CD80 polypeptide can increase the signaling induced by one, two or three of CD28, PD-L1, and CTLA-4, and/or a decrease the signaling induced by one, two or three of CD28, PD-L1, and CTLA-4, relative to a wild-type or unmodified CD80 polypeptide.

In some embodiments, the variant CD80 polypeptide increases the signaling induced by CTLA-4, relative to a wild-type or unmodified CD80 polypeptide. In some embodiments, the variant CD80 polypeptide increases the signaling induced by PD-L1/PD-1, relative to a wild-type or unmodified CD80 polypeptide. In some embodiments, the variant CD80 polypeptide increases the signaling induced by CD28, upon binding, relative to a wild-type or unmodified CD80 polypeptide. In some preferred embodiments, the variant CD80 polypeptide decreases the signaling induced by CD28, upon binding, relative to a wild-type or unmodified CD80 polypeptide. In some embodiments, the variant CD80 decreases the signaling induced by PD-L1/PD-1, relative to a wild-type or unmodified CD80 polypeptide. In some embodiments, the variant CD80 polypeptide decreases the signaling induced by CTLA-4, relative to a wild-type or unmodified CD80 polypeptide.

In some embodiments, the variant CD80 polypeptide increases the signaling induced by CTLA-4 and CD28, relative to a wild-type or unmodified CD80 polypeptide. In some embodiments, the variant CD80 polypeptide increases the signaling induced by CTLA-4 and decreases the signaling induced by CD28, relative to a wild-type or unmodified CD80 polypeptide. In some embodiments, the variant CD80 polypeptide decreases the signaling induced by CTLA-4 and CD28, relative to a wild-type or unmodified CD80 polypeptide.

In some embodiments, the variant CD80 polypeptide increases the signaling induced by CTLA-4 and CD28, relative to a wild-type or unmodified CD80 polypeptide. In some embodiments, the variant CD80 polypeptide increases the signaling induced by CTLA-4, and decreases the signaling induced by CD28, relative to a wild-type or unmodified CD80 polypeptide. In some embodiments, the variant CD80 polypeptide increases the signaling induced by CTLA-4 and CD28. In some embodiments, the variant CD80 polypeptide decreases the signaling induced by CTLA-4, and increases the signaling induced by CD28, relative to a wild-type or unmodified CD80 polypeptide. In some embodiments, the variant CD80 polypeptide decreases the signaling induced by CTLA-4 and increases the signaling induced by CD28, relative to a wild-type or unmodified CD80 polypeptide. In some embodiments, the variant CD80 polypeptide decreases the signaling induced by CTLA-4 and CD28, relative to a wild-type or unmodified CD80 polypeptide.

In some embodiments, a variant CD80 polypeptide that stimulates or increases the inhibitory signaling induced by CTLA-4 will produce a signal that is 90%, 85%, 80%, 75%, 70%, 65%, 60%, 55%, 50%, 45%, 40%, 35%, 30%, 25%, 20%, 15%>, 10%, 5% or less than the signal induced by the wild-type or unmodified CD80 polypeptide. In such examples, the wild-type or unmodified CD80 polypeptide has the same sequence as the variant CD80 polypeptide except that it does not contain the one or more amino acid modifications (e.g., substitutions).

In some embodiments, a variant CD80 polypeptide that stimulates or increases the signaling induced by CD28 will produce a signal that is at least 105%, 110%, 120%, 150%, 200%, 300%, 400%, or 500%, or more of the signal induced by the wild-type or unmodified CD80 polypeptide. In such examples, the wild-type or unmodified CD80 polypeptide has the same sequence as the variant CD80 polypeptide except that it does not contain the one or more amino acid modifications (e.g., substitutions).

In some embodiments, a variant CD80 polypeptide that inhibits or decreases the inhibitory signaling induced by CTLA-4 will produce a signal that is at least 105%, 110%, 120%, 150%, 200%, 300%, 400%, or 500%, or more of the signal induced by the wild-type or unmodified CD80 polypeptide. In such examples, the wild-type or unmodified CD80 polypeptide has the same sequence as the variant CD80 polypeptide except that it does not contain the one or more amino acid modifications (e.g., substitutions).

In some embodiments, a variant CD80 polypeptide that inhibits or decreases the inhibitory signaling induced by CD28 will produce a signal that is 90%, 85%, 80%, 75%, 70%, 65%, 60%, 55%, 50%, 45%, 40%, 35%, 30%, 25%, 20%, 15%, 10%, 5%, or less, of the signal induced by the wild-type or unmodified CD80 polypeptide. In such examples, the wild-type or unmodified CD80 polypeptide has the same sequence as the variant CD80 polypeptide except that it does not contain the one or more amino acid modifications (e.g., substitutions).

In some embodiments, a variant CD80 polypeptide that affects the inhibitory signaling induced by CTLA-4 and/or affects the signaling by CD28 will yield a sum of the CTLA-4 and CD28 signaling that is less than the sum of the CTLA-4 and CD28 signaling effected by the corresponding wild-type or unmodified CD80 polypeptide. In such embodiments, the sum of the CTLA-4 and CD28 signaling is 90%, 85%, 80%, 75%, 70%, 65%, 60%, 55%, 50%, 45%, 40%, 35%, 30%, 25%, 20%, 15%, 10%, 5%, or less, of the signal effected by the corresponding wild-type or unmodified CD80 polypeptide. In such examples, the corresponding wild-type or unmodified CD80 polypeptide has the same sequence as the variant CD80 polypeptide except that it does not contain the one or more amino acid modifications (e.g., substitutions).

In some embodiments, a variant CD80 polypeptide that affects the inhibitory signaling induced by CTLA-4 and/or affects the signaling by CD28 will yield a sum of the CTLA-4 and CD28 signaling that is greater than the sum of the CTLA-4 and CD28 signaling effected by the corresponding wild-type or unmodified CD80 polypeptide. In such embodiments, the sum of the CTLA-4 and CD28 signaling is at least 105%, 110%, 120%, 150%, 200%, 300%, 400%, or 500%, or more of the signal effected by the corresponding wild-type or unmodified CD80 polypeptide. In such examples, the corresponding wild-type or unmodified CD80 polypeptide has the same sequence as the variant CD80 polypeptide except that it does not contain the one or more amino acid modifications (e.g., substitutions). 1. CTLA4

In some embodiments, the variant CD80 polypeptide exhibits increased affinity for the ectodomain of CTLA-4 compared to a wild-type or unmodified CD80 polypeptide, such as a wildtype or unmodified CD80 polypeptide, comprising the sequence set forth in SEQ ID NO: 2, 76, 150, 3030 or 3031. In some embodiments, the variant CD80 polypeptide exhibits increased affinity for the ectodomain of CTLA-4 and decreased affinity for the ectodomain of CD28, compared to wild-type or unmodified CD80 polypeptide, such as comprising the sequence set forth in SEQ ID NO: 2, 76, 150, 3030, or 3031. In some embodiments, the increased affinity to the ectodomain of CTLA-4 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to binding affinity of the unmodified CD80 for the ectodomain of CTLA-4.

In some of these embodiments, the variant CD80 polypeptide that exhibits increased binding affinity for CTLA-4 compared to a wild-type or unmodified CD80 polypeptide has one or more amino acid modifications (e.g., substitutions) corresponding to positions 7, 12, 13, 16, 18, 20, 22, 23, 24, 26, 27, 30, 33, 35, 37, 38, 41, 42, 43, 44, 46, 47, 48, 52, 53, 54, 57, 58, 61, 62, 63, 67, 68, 69, 70, 71, 72, 73, 74, 77, 79, 81, 83, 84, 85, 87, 88, 89, 90, 91, 92, 93, 94, 95, and/or 97 of SEQ ID NO: 2, 76, 150, 3030, or 3031. In some of these embodiments, the variant CD80 polypeptide that exhibits increased binding affinity for CTLA-4 compared to a wild-type or unmodified CD80 polypeptide has one or more amino acid modifications (e.g., substitutions) corresponding to positions 7, 23, 26, 30, 35, 46, 57, 58, 71, 73, 79, and/or 84 of SEQ ID NO: 2, 76, 150, 3030 or 3031.

In some embodiments, the variant CD80 polypeptide has one or more amino acid substitutions selected from the group consisting of E7D, A12T, T13A, T13R, S15T, C16R, H18A, H18C, H18F, H181, H18L, H18T, H18V, H18Y, V20I, S21P, V22A, V22D, V22L, E23D, E23G, E24D, A26D, A26E, A26G, A26H, A26K, A26N, A26P, A26Q, A26R, A26S, A26T, Q27H, Q27L, Q27R, I30V, Q33L, Q33R, E35D, E35G, K37E, M38I, M38T, M38V, T41S, M42V, M431, M43L, M43T, M43V, S44P, D46E, D46N, D46V, M47I, M47L, M47T, M47V, M47Y, N48D, N48H, N48K, N48R, N48S, N48T, N48Y, E52D, Y53F, Y53H, K54E, K54R, T57A, T57I, 158V, 161F, I61N, 161V, T62A, T62N, T62S, N63D, N64S, 167L, 167T, V68E, V68I, V68L, V68M, I69F, L70M, L70Q, L70R, A71D, A71G, L72P, L72V, R73H, P74S, E77A, T79I, T79M, E81G, E81K, V83I, V84I, L85M, L85Q, Y87C, Y87D, Y87N, E88D, E88V, K89N, D90G, D90N, D90P, A91G, A91S, A91V, F92V, F92Y, K93E, K93R, K93T, R94L, R94Q, R94W, E95D, E95K, E95V, L97Q, and L97R. In some embodiments, the variant CD80 polypeptide has one or more amino acid substitutions selected from the group consisting of E7D, T13A, T13R, S15T, C16R, H18A, H18C, H18F, H18I, H18T, H18V, V20I, V22D, V22L, E23D, E23G, E24D, A26D, A26E, A26G, A26H, A26K, A26N, A26P, A26Q, A26R, A26S, A26T, Q27H, Q27L, I30V, Q33L, Q33R, E35D, E35G, T41S, M42V, M43L, M43T, D46E, D46N, D46V, M47I, M47L, M47V, M47Y, N48D, N48H, N48K, N48R, N48S, N48T, N48Y, Y53F, K54E, K54R, T57A, T57I, 158V, 161F, 161V, T62A, T62N, 167L, V68E, V681, V68L, 169F, L70M, A71D, A71G, L72V, R73H, P74S, T79I, T79M, E81G, E81K, V84I, L85M, L85Q, Y87C, Y87D, E88V, D90P, F92V, R94Q, R94W, E95D, E95V, and L97Q.

In some embodiments, the one or more amino acid substitution is Q27H/T41S/A71D, T13R/C16R/L70Q/A71D, T57I, V22L/M38V/M47T/A71D/L85M, S44P/167T/P74S/E81G/E95D, A71D, T13A/161N/A71D, E35D/M47I, M47V/N48H, V20I/M47V/T57I/V84I, V20I/M47V/A71D, A71D/L72V/E95K, V22L/E35G/A71D/L72P, E35D/A71D, E35D/167L/A71D, Q27H/E35G/A71D/L72P/T79I, T13R/M42V/M47I/A71D, E35D, E35D/M47I/L70M, E35D/A71D/L72V, E35D/M43L/L70M, A26P/E35D/M431/L85Q/E88D, E35D/D46V/L85Q, Q27L/E35D/M47I/T57I/L70Q/E88D, M47V/169F/A71D/V831, E35D/T57A/A71D/L85Q, H18Y/A26T/E35D/A71D/L85Q, E35D/M47L, E23D/M42V/M431/158V/L70R, V68M/L70M/A71D/E95K, E35D/M431/A71D, T41S/T57I/L70R, H18Y/A71D/L72P/E88V, V20I/A71D, E23G/A26S/E35D/T62N/A71D/L72V/L85M, A12T/E24D/E35D/D46V/161V/L72P/E95V, E35G/K54E/A71D/L72P, L70Q/A71D, A26E/E35D/M47L/L85Q, D46E/A71D, E35D/M47L/L85Q, H18Y/E35D/M47L, A26E/E35D/M43T/M47L/L85Q/R94Q, E24D/Q33L/E35D/M47V/K54R/L85Q, E7D/E35D/M47I/L97Q, H18L/V22A/E35D/M47L/N48T/L85Q, Q27H/E35D/M47L/L85Q/R94Q/E95K, E35D/M47I/E77A/L85Q/R94W, V22A/E35D/V68E/A71D, E35D/M47L/A71G/L97Q, E35D/M47V/A71G/L85M/L97Q, E35D/D46E/M47V/L97Q, E35D/D46V/M47I/A71G/F92V, E35D/L85Q/K93T/E95V/L97Q, Q27H/E35D/M47I/L85Q/D90G, E35D/M47I/L85Q/D90G, E35D/M47I/T62S/L85Q, A26E/E35D/M47L/A71G, V22A/E35D/M47/Y87N, H18Y/A26E/E35D/M47L/L85Q/D90G, E35D/M47V/A71G/E88D, E35D/A71G, E35D/M47V/A71G, I30V/E35D/M47V/A71G/A91V, V22D/E35D/M47L/L85Q, H18Y/E35D/N48K, E35D/T41S/M47V/A71G/K89N, E35D/M47V/N48T/L85Q, E35D/D46E/M47V/A71D/D90G, E35D/D46E/M47V/A71D, E35D/T41S/M43I/A71G/D90G, E35D/T41S/M43I/M47V/A71G, E35D/T41S/M43I/M47L/A71G, H18Y/V22A/E35D/M47V/T62S/A71G, H18Y/A26E/E35D/M47L/V68M/A71G/D90G, E35D/K37E/M47V/N48D/L85Q/D90N, E35D/D46V/M47L/V68M/L85Q/E88D, E35D/T41S/M43V/M47I/L70M/A71G, E35D/D46E/M47V/N63D/L85Q, E35D/M47V/T62A/A71D/K93E, E35D/D46E/M47V/V68M/D90G/K93E, E35D/M43I/M47V/K89N, E35D/M47L/A71G/L85M/F92Y, E35D/M42V/M47V/E52D/L85Q, E35D/T41S/M47V/L97Q, E35D/Y53H/A71G/D90G/L97R, E35D/A71D/L72V/R73H/E81K, E35D/M38T/D46E/M47V/N48S, E35D/M38T/M43V/M47V/N48R/L85Q, E35D/N48K/L72V, E35D/T41S/N48T, D46V/M47I/A71G, M47I/A71G, E35D/M43I/M47L/L85M, E35D/M43I/D46E/A71G/L85M, H18Y/E35D/M47L/A71G/A91S, E35D/M47I/N48K/I61F, E35D/M47V/T62S/L85Q, M43I/M47L/A71G, E35D/M47V, E35D/M47L/A71G/L85M, V22A/E35D/M47L/A71G, E35D/M47L/A71G, E35D/D46E/M47I, Q27H/E35D/M47I, E35D/D46E/L85M, E35D/D46E/A91G, E35D/D46E, E35D/L97R, H18Y/E35D, Q27L/E35D/M47V/I61V/L85M, E35D/M47V/I61V/L85M, E35D/M47V/L85M/R94Q, E35D/M47V/N48K/L85M, H18Y/E35D/M47V/N48K, A26E/Q27R/E35D/M47L/N48Y/L85Q, E35D/M47I/T62S/L85Q/E88D, E24D/Q27R/E35D/T41S/M47V/L85Q, S15T/H18Y/E35D/M47V/T62A/N64S/A71G/L85Q/D90N, E35D/M47L/V68M/A71G/L85Q/D90G, H18Y/E35D/M47I/V68M/A71G/R94L, H18Y/V22A/E35D/T41S/M47V/T62N/A71G/A91G, E24D/E35D/M47L/V68M/E95V/L97Q, E35D/D46E/M47I/T62A/V68M/L85M/Y87C, E35D/D46E/M47I/V68M/L85M, E35D/D46E/M47L/V68M/A71G/Y87C/K93R, E35D/D46E/M47L/V68M/T79M/L85M, E35D/D46E/M47V/V68M/L85Q, E35D/M43I/M47L/V68M, E35D/M47I/V68M/Y87N, E35D/M47L/V68M/E95V/L97Q, E35D/M47L/Y53F/V68M/A71G/K93R/E95V, E35D/M47V/N48K/V68M/A71G/L85M, E35D/M47V/N48K/V68M/L85M, E35D/M47V/V68M/L85M, E35D/M47V/V68M/L85M/Y87D, E35D/T41S/D46E/M47I/V68M/K93R/E95V, H18Y/E35D/D46E/M47I/V68M/R94L, H18Y/E35D/D46E/M47I/V68M/R94L, H18Y/E35D/M47I/V68M/Y87N, H18Y/E35D/M47I/V68M/Y87N, H18Y/E35D/M47L/V68M/A71G/L85M, H18Y/E35D/M47L/V68M/A71G/L85M, H18Y/E35D/M47L/V68M/E95V/L97Q, H18Y/E35D/M47L/V68M/E95V/L97Q, H18Y/E35D/M47L/Y53F/V68M/A71G, H18Y/E35D/M47L/Y53F/V68M/A71G/K93R/E95V, H18Y/E35D/M47V/V68M/L85M, H18Y/E35D/V68M/A71G/R94Q/E95V, H18Y/E35D/V68M/L85M/R94Q, H18Y/E35D/V68M/T79M/L85M, H18Y/V22D/E35D/M47V/N48K/V68M, S21P/E35D/K37E/D46E/M47I/V68M, S21P/E35D/K37E/D46E/M47I/V68M/R94L, T13R/E35D/M47L/V68M, T13R/Q33R/E35D/M381/M47L/V68M/E95V/L97Q, T13R/Q33R/E35D/M381/M47L/V68M/L85M, T13R/Q33R/E35D/M381/M47L/V68M/L85M/R94Q, T13R/Q33R/E35D/M47L/V68M, T13R/Q33R/E35D/M47L/V68M/L85M, V22D/E24D/E35D/M47L/V68M, V22D/E24D/E35D/M47L/V68M/L85M/D90G, V22D/E24D/E35D/M47V/V68M, H18Y/E35D/M47V/V68M/A71G, H18C/A26P/E35D/M47L/V68M/A71G, H18I/A26P/E35D/M47V/V68M/A71G, H18L/A26N/D46E/V68M/A71G/D90G, H18L/E35D/M47V/V68M/A71G/D90G, H18T/A26N/E35D/M47L/V68M/A71G, H18V/A26K/E35D/M47L/V68M/A71G, H18V/A26N/E35D/M47V/V68M/A71G, H18V/A26P/E35D/M47V/V68L/A71G, H18V/A26P/E35D/M47L/V68M/A71G, H18V/E35D/M47V/V68M/A71G/D90G, H18Y/A26P/E35D/M47I/V68M/A71G, H18Y/A26P/E35D/M47V/V68M/A71G, H18Y/E35D/M47V/V68L/A71G/D90G, H18Y/E35D/M47V/V68M/A71G/D90G, A26P/E35D/M47I/V68M/A71G/D90G, H18V/A26G/E35D/M47V/V68M/A71G/D90G, H18V/A26S/E35D/M47L/V68M/A71G/D90G, H18V/A26R/E35D/M47L/V68M/A71G/D90G, H18V/A26D/E35D/M47V/V68M/A71G/D90G, H18V/A26Q/E35D/M47V/V68L/A71G/D90G, H18A/A26P/E35D/M47L/V68M/A71G/D90G, H18A/A26N/E35D/M47L/V68M/A71G/D90G, H18F/A26P/E35D/M47I/V68M/A71G/D90G, H18F/A26H/E35D/M47L/V68M/A71G/D90G, H18F/A26N/E35D/M47V/V68M/A71G/D90K, H18Y/A26N/E35D/M47F/V68M/A71G/D90G, H18Y/A26P/E35D/M47Y/V68I/A71G/D90G, H18Y/A26Q/E35D/M47T/V68M/A71G/D90G, H18R/A26P/E35D/D46N/M47V/V68M/A71G/D90P, or H18F/A26D/E35D/D46E/M47T/V68M/A71G/D90G.

In some embodiments, a variant CD80 polypeptide exhibits its increased selectivity for CTLA-4 versus CD28 compared to the ratio of binding of the unmodified CD80 polypeptide (e.g., set forth in SEQ ID NO:2, 76, 150, 3030, or 3031) for CTLA-4 versus CD28, such as indicated by a ratio of CTLA-4 binding to CD28 binding (CTLA4:CD28 binding ratio) that is greater than 1. In some embodiments, the variant CD80 polypeptide exhibits a ratio of binding CTLA-4 versus CD28 that is greater than or greater than about or 1.1, 1.2, 1.3, 1.4, 1.5, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, or more. In some of these embodiments, the variant CD80 polypeptide has one or more amino acid modifications (e.g., substitutions) corresponding to positions 30, 35, 57, 71, or 84 of SEQ ID NO: 2, 76, 150, 3030, or 3031. In some embodiments, the variant CD80 polypeptide has one or more amino acid substitutions selected from the group consisting of T13A, T13R, S15T, V22I, V22L, Q27H, 130V, Q33R, E35D, E35G, T41S, M47I, M47L, M47V, N48Y, Y53F, T57, 161F, I61V, I67L, L70M, A71D, A71G, L72V, T79M, E81G, E81K, V84A, V84I, and L85M, Y87C, Y87D. In some embodiments, the one or more amino acid substitution is Q27H/T41S/A71D, T13R/C16R/L70Q/A71D, T57I, V22L/M38V/M47T/A71D/L85M, I30V/T57I/L70P/A71D/A91T, V22I/L70M/A71D, L72P/T79I, L25S/E35D/M47I/D90N, A71D, E81K/A91S, A12V/M47V/L70M, K34E/T41A/L72V, T41S/A71D/V84A, E35D/M47I, M47V/N48H, Q27H/M43I/A71D/R73S, M47I/E88D, M42I/I61V/A71D, P51A/A71D, H18Y/M47I/T57I/A71G, V20I/M47V/T57I/V84I, A71D/L72V/E95K, V22L/E35G/A71D/L72P, E35D/I67L/A71D, E35D, E35D/M43L/L70M, A26P/E35D/M431/L85Q/E88D, E35D/T57A/A71D/L85Q, E35G/K54E/A71D/L72P, A26E/E35D/M47L/L85Q, E35D/N48K/L72V, E35D/T41S/N48T, D46V/M47I/A71G, M47I/A71G, E35D/M43I/M47L/L85M, E35D/M43I/D46E/A71G/L85M, H18Y/E35D/M47L/A71G/A91S, E35D/M47I/N48K/I61F, E35D/M47V/T62S/L85Q, M43I/M47L/A71G, E35D/M47V, E35D/M47L/A71G/L85M, V22A/E35D/M47L/A71G, E35D/M47L/A71G, E35D/D46E/M47I, Q27H/E35D/M47I, E35D/D46E/L85M, E35D/D46E/A91G, E35D/D46E, E35D/L97R, H18Y/E35D, Q27L/E35D/M47V/I61V/L85M, E35D/M47V/I61V/L85M, E35D/M47V/L85M/R94Q, E35D/M47V/N48K/L85M, H18Y/E35D/M47V/N48K, A26E/Q27R/E35D/M47L/N48Y/L85Q, E35D/M47I/T62S/L85Q/E88D, E24D/Q27R/E35D/T41S/M47V/L85Q, S15T/H18Y/E35D/M47V/T62A/N64S/A71G/L85Q/D90N, E35D/M47L/V68M/A71G/L85Q/D90G, H18Y/E35D/M47I/V68M/A71G/R94L, H18Y/V22A/E35D/T41S/M47V/T62N/A71G/A91G, E24D/E35D/M47L/V68M/E95V/L97Q, E35D/D46E/M47I/T62A/V68M/L85M/Y87C, E35D/D46E/M47I/V68M/L85M, E35D/D46E/M47L/V68M/A71G/Y87C/K93R, E35D/D46E/M47L/V68M/T79M/L85M, E35D/D46E/M47V/V68M/L85Q, E35D/M43I/M47L/V68M, E35D/M47I/V68M/Y87N, E35D/M47L/V68M/E95V/L97Q, E35D/M47L/Y53F/V68M/A71G/K93R/E95V, E35D/M47V/N48K/V68M/A71G/L85M, E35D/M47V/N48K/V68M/L85M, E35D/M47V/V68M/L85M, E35D/M47V/V68M/L85M/Y87D, E35D/T41S/D46E/M47I/V68M/K93R/E95V, H18Y/E35D/D46E/M47I/V68M/R94L, H18Y/E35D/D46E/M47I/V68M/R94L, H18Y/E35D/M47I/V68M/Y87N, H18Y/E35D/M47I/V68M/Y87N, H18Y/E35D/M47L/V68M/A71G/L85M, H18Y/E35D/M47L/V68M/A71G/L85M, H18Y/E35D/M47L/V68M/E95V/L97Q, H18Y/E35D/M47L/V68M/E95V/L97Q, H18Y/E35D/M47L/Y53F/V68M/A71G, H18Y/E35D/M47L/Y53F/V68M/A71G/K93R/E95V, H18Y/E35D/M47V/V68M/L85M, H18Y/E35D/V68M/A71G/R94Q/E95V, H18Y/E35D/V68M/L85M/R94Q, H18Y/E35D/V68M/T79M/L85M, H18Y/V22D/E35D/M47V/N48K/V68M, S21P/E35D/K37E/D46E/M47I/V68M, S21P/E35D/K37E/D46E/M47I/V68M/R94L, T13R/E35D/M47L/V68M, T13R/Q33R/E35D/M381/M47L/V68M/E95V/L97Q, T13R/Q33R/E35D/M381/M47L/V68M/L85M, T13R/Q33R/E35D/M381/M47L/V68M/L85M/R94Q, T13R/Q33R/E35D/M47L/V68M, T13R/Q33R/E35D/M47L/V68M/L85M, V22D/E24D/E35D/M47L/V68M, V22D/E24D/E35D/M47L/V68M/L85M/D90G, V22D/E24D/E35D/M47V/V68M, H18Y/E35D/M47V/V68M/A71G, H18C/A26P/E35D/M47L/V68M/A71G, H18I/

A26P/E35D/M47V/V68M/A71G, H18L/A26N/D46E/V68M/A71G/D90G, H18L/E35D/M47V/V68M/A71G/D90G, H18T/A26N/E35D/M47L/V68M/A71G, H18V/A26K/E35D/M47L/V68M/A71G, H18V/A26N/E35D/M47V/V68M/A71G, H18V/A26P/E35D/M47V/V68L/A71G, H18V/A26P/E35D/M47L/V68M/A71G, H18V/E35D/M47V/V68M/A71G/D90G, H18Y/A26P/E35D/M47I/V68M/A71G, H18Y/A26P/E35D/M47V/V68M/A71G, H18Y/E35D/M47V/V68L/A71G/D90G, H18Y/E35D/M47V/V68M/A71G/D90G, A26P/E35D/M47I/V68M/A71G/D90G, H18V/A26G/E35D/M47V/V68M/A71G/D90G, H18V/A26S/E35D/M47L/V68M/A71G/D90G, H18V/A26R/E35D/M47L/V68M/A71G/D90G, H18V/A26D/E35D/M47V/V68M/A71G/D90G, H18V/A26Q/E35D/M47V/V68L/A71G/D90G, H18A/A26P/E35D/M47L/V68M/A71G/D90G, H18A/A26N/E35D/M47L/V68M/A71G/D90G, H18F/A26P/E35D/M47I/V68M/A71G/D90G, H18F/A26H/E35D/M47L/V68M/A71G/D90G, H18F/A26N/E35D/M47V/V68M/A71G/D90K, H18Y/A26N/E35D/M47F/V68M/A71G/D90G, H18Y/A26P/E35D/M47Y/V68I/A71G/D90G, H18Y/A26Q/E35D/M47T/V68M/A71G/D90G, H18R/A26P/E35D/D46N/M47V/V68M/A71G/D90P, or H18F/A26D/E35D/D46E/M47T/V68M/A71G/D90G.

2. CD28

In some embodiments, the variant CD80 polypeptide exhibits increased affinity for the ectodomain of CD28 compared to a wild-type or unmodified CD80 polypeptide. In some embodiments, the variant CD80 polypeptide exhibits its increased affinity to the ectodomain of CD28 compared to a wildtype or unmodified CD80 polypeptide, such as comprising the sequence set forth in SEQ ID NO: 2, 76, 150, 3030, or 3031. In some embodiments, the increased affinity to the ectodomain of CD28 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold 60-fold, 70-fold, 80-fold, 90-fold, 100-fold, 150-fold, or 200-fold, compared to binding affinity of the unmodified CD80 for the ectodomain of CD28.

In some embodiments, the variant CD80 polypeptide exhibits increased affinity for the ectodomain of CD28 and the ectodomain of CTLA-4 compared to a wildtype or unmodified CD80 polypeptide, such as comprising the sequence set forth in SEQ ID NO: 2, 76, 150, 3030, or 3031. In some embodiments, the variant CD80 polypeptide exhibits its increased affinity for the ectodomain of CD28, the ectodomain of PD-L1 and the ectodomain of CTLA-4 compared to wild-type or an unmodified CD80 polypeptide, such as comprising the sequence set forth in SEQ ID NO: 2, 76, 150, 3030, or 3031. In some embodiments, the increased affinity to the ectodomain of CD28 and one or both of CTLA-4 and PD-L1 is independently increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100-fold, 150-fold, 200-fold, 250-fold, 300-fold, 350-fold, 400-fold, or 450-fold compared to binding affinity of the unmodified CD80 for the ectodomain of CTLA-4 or PD-L1.

In some embodiments, the variant CD80 polypeptide exhibits increased affinity for the ectodomain of CD28, and decreased affinity for the ectodomain of CTLA-4, compared to wild-type or unmodified CD80 polypeptide, such as comprising the sequence set forth in SEQ ID NO: 2, 76, 150, 3030, or 3031. In some embodiments, the variant CD80 polypeptide exhibits increased affinity for the ectodomain of CD28 and the ectodomain of PD-L1, and decreased affinity for the ectodomain of CTLA-4, compared to wild-type or unmodified CD80 polypeptide, such as comprising the sequence set forth in SEQ ID NO: 2, 76, 150, 3030, or 3031. In some embodiments, the decreased affinity to the ectodomain of CTLA-4 is decreased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to binding affinity of the unmodified CD80 for the ectodomain of CTLA-4.

In some of these embodiments, the variant CD80 polypeptide that exhibits increased binding affinity for CD28 compared to a wild-type or unmodified CD80 polypeptide has one or more amino acid modifications (e.g., substitutions) corresponding to positions 12, 13, 18, 20, 22, 23, 24, 26, 27, 31, 35, 41, 42, 43, 46, 47, 54, 55, 57, 58, 61, 62, 67, 68, 69, 70, 71, 72, 79, 83, 84, 85, 88, 90, 93, 94, and/or 95 of SEQ ID NO: 2, 76, 150, 3030, or 3031. In some of these embodiments, the variant CD80 polypeptide that exhibits increased binding affinity for CD28 compared to a wild-type or unmodified CD80 polypeptide has one or more amino acid modifications (e.g., substitutions) corresponding to positions 23, 26, 35, 46, 55, 57, 58, 71, 79, and/or 84 of SEQ ID NO: 2, 76, 150, 3030, or 3031.

In some embodiments, the variant CD80 polypeptide has one or more amino acid substitutions selected from the group consisting of A12T, T13R, S15T, H18A, H18C, H18F, H8I, H18T, H18V, H18Y, V20I, S21P, V22A, V22D, V22L, E23D, E23G, E24D, A26D, A26E, A26G, A26H, A26K, A26N, A26P, A26Q, A26R, A26S, A26T, Q27H, Q27L, Q27R, Y31H, Q33R, E35D, E35G, K37E, M381, T41S, M42V, M431, M43L, D46E, D46N, D46V, M47I, M47L, M47V, M47Y, N48K, N48Y, Y53F, K54E, N55I, T57A, T57, 158V, I61F, I61V, T62A, T62N, T62S, N64S, I67L, V68E, V68I, V68L, V68M, I69F, L70M, L70Q, L70R, A71D, A71G, L72P, L72V, T79I, T79M, V83I, V84I, L85M, L85Q, Y87C, Y87D, Y87N, E88D, E88V, D90G, D90N, D90P, A91G, A91S, K93E, K93R, R94L, R94Q, R94W, E95K, E95V, and L97Q. In some embodiments, the variant CD80 polypeptide has one or more amino acid substitutions selected from the group consisting of T13R, S15T, H18A, H18C, H18F, H18I, H18T, H18V, V20I, V22D, V22L, E23D, E23G, E24D, A26D, A26E, A26G, A26H, A26K, A26N, A26P, A26Q, A26R, A26S, A26T, Q27H, Q27L, Q33R, E35D, E35G, T41S, M42V, M43L, D46E, D46N, D46V, M47I, M47L, M47V, M47Y, N48K, N48Y, Y53F, K54E, N55I, T57A, T57, 158V, I61F, I61V, T62A, T62N, I67L, V68E, V68I, V68L, I69F, L70M, A71D, A71G, L72V, T79I, T79M, V84I, L85M, L85Q, Y87C, Y87D, E88V, D90P, R94Q, R94W, E95V, L97Q.

In some embodiments, the one or more amino acid substitution is Q27H/T41S/A71D, V20I/M47V/T57I/V84I, V20I/M47V/A71D, A71D/L72V/E95K, V22L/E35G/A71D/L72P, E35D/A71D, E35D/I67L/A71D, Q27H/E35G/A71D/L72P/T79I, T13R/M42V/M47I/A71D, E35D, E35D/M47I/L70M, E35D/A71D/L72V, E35D/M43L/L70M, A26P/E35D/M43I/L85Q/E88D, E35D/D46V/L85Q, Q27L/E35D/M47I/T57I/L70Q/E88D, M47V/I69F/A71D/V83I, E35D/T57A/A71D/L85Q, H18Y/A26T/E35D/A71D/L85Q, E35D/M47L, E23D/M42V/M43I/I58V/L70R, V68M/L70M/A71D/E95K, N55I/T57I/I69F, E35D/M43I/A71D, T41S/T57I/L70R, H18Y/A71D/L72P/E88V, V20I/A71D, E23G/A26S/E35D/T62N/A71D/L72V/L85M, A12T/E24D/E35D/D46V/I61V/L72P/E95V, E35G/K54E/A71D/L72P, L70Q/A71D, A26E/E35D/M47L/L85Q, D46E/A71D, Y31H/E35D/T41S/V68L/K93R/R94W, V22A/E35D/V68E/A71D, E35D/D46E/M47V/V68M/D90G/K93E, E35D/

N48K/L72V, D46V/M47I/A71G, M47I/A71G, E35D/M43I/M47L/L85M, E35D/M43I/D46E/A71G/L85M, H18Y/E35D/M47L/A71G/A91S, E35D/M47I/N48K/I61F, E35D/M47V/T62S/L85Q, M43I/M47L/A71G, E35D/M47V, E35D/M47L/A71G/L85M, V22A/E35D/M47L/A71G, E35D/M47L/A71G, E35D/D46E/M47I, Q27H/E35D/M47I, E35D/D46E/L85M, E35D/D46E/A91G, E35D/D46E, H18Y/E35D, Q27L/E35D/M47V/I61V/L85M, E35D/M47V/I61V/L85M, E35D/M47V/N48K/L85M, H18Y/E35D/M47V/N48K, A26E/Q27R/E35D/M47L/N48Y/L85Q, E35D/M47I/T62S/L85Q/E88D, E24D/Q27R/E35D/T41S/M47V/L85Q, S15T/H18Y/E35D/M47V/T62A/N64S/A71G/L85Q/D90N, E35D/M47L/V68M/A71G/L85Q/D90G, H18Y/E35D/M47I/V68M/A71G/R94L, H18Y/V22A/E35D/T41S/M47V/T62N/A71G/A91G, E35D/D46E/M47I/T62A/V68M/L85M/Y87C, E35D/D46E/M47I/V68M/L85M, E35D/D46E/M47L/V68M/A71G/Y87C/K93R, E35D/D46E/M47L/V68M/T79M/L85M, E35D/D46E/M47V/V68M/L85Q, E35D/M43I/M47L/V68M, E35D/M47I/V68M/Y87N, E35D/M47L/Y53F/V68M/A71G/K93R/E95V, E35D/M47V/N48K/V68M/A71G/L85M, E35D/M47V/N48K/V68M/L85M, E35D/M47V/V68M/L85M, E35D/M47V/V68M/L85M/Y87D, E35D/T41S/D46E/M47I/V68M/K93R/E95V, H18Y/E35D/D46E/M47I/V68M/R94L, H18Y/E35D/D46E/M47I/V68M/R94L, H18Y/E35D/M47I/V68M/Y87N, H18Y/E35D/M47I/V68M/Y87N, H18Y/E35D/M47L/V68M/A71G/L85M, H18Y/E35D/M47L/V68M/A71G/L85M, H18Y/E35D/M47L/V68M/E95V/L97Q, H18Y/E35D/M47L/Y53F/V68M/A71G, H18Y/E35D/M47L/Y53F/V68M/A71G/K93R/E95V, H18Y/E35D/M47L/Y53F/V68M/A71G/K93R/E95V, H18Y/E35D/M47V/V68M/L85M, H18Y/E35D/M47V/V68M/L85M, H18Y/E35D/V68M/A71G/R94Q/E95V, H18Y/E35D/V68M/L85M/R94Q, H18Y/E35D/V68M/T79M/L85M, H18Y/V22D/E35D/M47V/N48K/V68M, S21P/E35D/K37E/D46E/M47I/V68M, S21P/E35D/K37E/D46E/M47I/V68M/R94L, T13R/Q33R/E35D/M381/M47L/V68M/E95V/L97Q, T13R/Q33R/E35D/M47L/V68M/L85M, V22D/E24D/E35D/M47L/V68M, V22D/E24D/E35D/M47L/V68M/L85M/D90G, V22D/E24D/E35D/M47V/V68M, H18Y/E35D/M47V/V68M/A71G, H18C/A26P/E35D/M47L/V68M/A71G, H18I/A26P/E35D/M47V/V68M/A71G, H18L/A26N/D46E/V68M/A71G/D90G, H18L/E35D/M47V/V68M/A71G/D90G, H18T/A26N/E35D/M47L/V68M/A71G, H18V/A26K/E35D/M47L/V68M/A71G, H18V/A26N/E35D/M47V/V68M/A71G, H18V/A26P/E35D/M47V/V68L/A71G, H18V/A26P/E35D/M47L/V68M/A71G, H18V/E35D/M47V/V68M/A71G/D90G, H18Y/A26P/E35D/M47I/V68M/A71G, H18Y/A26P/E35D/M47V/V68M/A71G, H18Y/E35D/M47V/V68L/A71G/D90G, H18Y/E35D/M47V/V68M/A71G/D90G, A26P/E35D/M47I/V68M/A71G/D90G, H18V/A26G/E35D/M47V/V68M/A71G/D90G, H18V/A26S/E35D/M47L/V68M/A71G/D90G, H18V/A26R/E35D/M47L/V68M/A71G/D90G, H18V/A26D/E35D/M47V/V68M/A71G/D90G, H18V/A26Q/E35D/M47V/V68L/A71G/D90G, H18A/A26P/E35D/M47L/V68M/A71G/D90G, H18A/A26N/E35D/M47L/V68M/A71G/D90G, H18F/A26P/E35D/M47I/V68M/A71G/D90G, H18F/A26H/E35D/M47L/V68M/A71G/D90G, H18F/A26N/E35D/M47V/V68M/A71G/D90K, H18Y/A26P/E35D/M47Y/V68I/A71G/D90G, H18Y/A26Q/E35D/M47T/V68M/A71G/D90G, H18R/A26P/E35D/D46N/M47V/V68M/A71G/D90P, or H18F/A26D/E35D/D46E/M47T/V68M/A71G/D90G.

3. PD-L1

In some embodiments, the variant CD80 polypeptide exhibits increased affinity to PD-L1 compared to the wildtype or unmodified CD80 polypeptide. In some embodiments, the variant CD80 polypeptide exhibits increased affinity for the ectodomain of PD-L1 and the ectodomain of CTLA-4 compared to wild-type or an unmodified CD80 polypeptide, such as comprising the sequence set forth in SEQ ID NO: 2, 76, 150, 3030, or 3031. In some embodiments, the increased affinity to the ectodomain of PD-L1 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100-fold, 150-fold, 200-fold, 250-fold, 300-fold, 350-fold, 400-fold, or 450-fold compared to binding affinity of the unmodified CD80 for the ectodomain of PD-L1.

In some embodiments, the variant CD80 polypeptide exhibits increased affinity for the ectodomain of PD-L1, and decreased affinity for the ectodomain of CTLA-4, compared to wild-type or unmodified CD80 polypeptide, such as comprising the sequence set forth in SEQ ID NO: 2, 76, 150, 3030, or 3031. In some embodiments, the variant CD80 polypeptide exhibits increased affinity for the ectodomain of PD-L1, and decreased affinity for the ectodomain of CD28, compared to wild-type or unmodified CD80 polypeptide, such as comprising the sequence set forth in SEQ ID NO: 2, 76, 150, 3030, or 3031. In some embodiments, the decreased affinity to the ectodomain of CTLA-4 or CD28 is decreased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to binding affinity of the unmodified CD80 for the ectodomain of CTLA-4 or CD28.

In some of these embodiments, the variant CD80 polypeptide that exhibits increased binding affinity for PD-L1 compared to a wild-type or unmodified CD80 polypeptide has one or more amino acid modifications (e.g., substitutions) corresponding to positions 7, 12, 13, 15, 16, 18, 20, 22, 23, 24, 25, 26, 27, 28, 29, 30, 31, 33, 34, 35, 36, 37, 38, 41, 42, 43, 44, 46, 47, 48, 51, 53, 54, 55, 57, 58, 61, 62, 63, 65, 67, 68, 69, 70, 71, 72, 73, 74, 76, 77, 78, 79, 81, 82, 83, 84, 85, 86, 87, 88, 89, 90, 91, 92, 93, 94, 95, and/or 97 of SEQ ID NO: 2, 76, 150, 3030, or 3031. In some of these embodiments, the variant CD80 polypeptide that exhibits increased binding affinity for PD-L1 compared to a wild-type or unmodified CD80 polypeptide has one or more amino acid modifications (e.g., substitutions) corresponding to positions 7, 23, 26, 30, 34, 35, 46, 51, 55, 57, 58, 65, 71, 73, 78, 79, 82, and/or 84, of SEQ ID NO: 2, 76, 150, 3030, or 3031.

In some embodiments, the variant CD80 polypeptide has one or more amino acid substitutions selected from the group consisting of E7D, A12V, T13A, T13R, S15P, S15T, C16R, H18A, H18C, H18F, H18I, H18T, H18V, H18L, H18Y, V20A, V20I, S21P, V22A, V22D, V22I, V22L, E23D, E23G, E24D, L25S, A26D, A26E, A26G, A26H, A26K, A26N, A26P, A26Q, A26R, A26S, A26T, Q27H, Q27L, Q27R, R29C, T28Y, R29H, I30T, I30V, Y31H, Y31S, Q33E, Q33H, Q33K, Q33L, Q33R, K34E, E35D, K36R, K37E, M381, M38T, M38V, T41A, T41S, M42I, M42V, M43I, M43L, M43T, M43V, S44P, D46E, D46N, D46V, M47F, M47I, M47L, M47T, M47V, N48D, N48H, N48K, N48R, N48S, N48T, N48Y, P51A, Y53F, Y53H, K54R, N55D, N55I, T57I, 158V, I61F, I61N, I61V, T62A, T62N, T62S, N63D, N64S, L65P, I67L, I67T, V68A, V68I, V68L, V68M, I69F, L70M, L70P, L70Q, L70R, A71D, A71G, L72P, L72V, R73S, P74S, D76H, E77A, G78A, T79A, T79I, T79L, T79M, T79P, E81G, E81K, C82R, V83A, V83I, V84A, V84I, L85E, L85M, L85Q, K86E, K86M, Y87C, Y87D, Y87H, Y87N, Y87Q, E88D, E88G, K89E, K89N, D90G, D90N, D90P, A91G, A91S, A91T, A91V, F92L, F92S, F92V, F92Y, K93E, K93R, K93T, R94L, R94Q, R94W, E95D, E95K, E95V, L97M, L97Q, and L97R. In some embodiments, the variant CD80 polypeptide has one or more amino acid substitutions selected from the group consisting of E7D, T13A, T13R, S15T, C16R, H18A, H18C, H18F, H18I, H18T, H18V, V20A, V20I, V22D, V22I, V22L, E23D, E23G, E24D, L25S, A26D, A26E, A26G, A26H, A26K, A26N, A26P, A26Q, A26R, A26S, A26T, Q27H, Q27L, 130T, 130V, Q33E, Q33K, Q33L, Q33R, K34E, E35D, K36R, T41S, M421, M42V, M43L, M43T, D46E, D46N, D46V, M47F, M47I, M47L, M47V, N48D, N48H, N48K, N48R, N48S, N48T, N48Y, P51A, Y53F, K54R, N55D, N55I, T57I, 158V, I61F, I61V, T62A, T62N, L65P, I67L, V68I, V68L, I69F, L70M, A71D, A71G, L72V, R73S, P74S, D76H, G78A, T79A, T79I, T79L, T79M, T79P, E81G, E81K, C82R, V84A, V84I, L85E, L85M, L85Q, K86M, Y87C, Y87D, D90P, F92S, F92V, R94Q, R94W, E95D, E95V, L97M, and L97Q.

In some embodiments, the one or more amino acid substitution is Q27H/T41S/A71D, 130T/L70R, T13R/C16R/L70Q/A71D, T57I, M431/C82R, V22L/M38V/M47T/A71D/L85M, I30V/T57I/L70P/A71D/A91T, V22I/L70M/A71D, N55D/K86M, L72P/T79I, L70P/F92S, T79P, E35D/M47I/L65P/D90N, L25S/E35D/M47I/D90N, S44P/I67T/P74S/E81G/E95D, A71D, T13A/I61N/A71D, E81K, A12V/M47V/L70M, K34E/T41A/L72V, T41S/A71D/V84A, E35D/A71D, E35D/M47I, K36R/G78A, Q33E/T41A, M47V/N48H, M47L/V68A, S44P/A71D, Q27H/M43I/A71D/R73S, E35D/T57I/L70Q/A71D, M47I/E88D, M42I/I61V/A71D, P51A/A71D, H18Y/M47I/T57I/A71G, V20I/M47V/T57I/V84I, V20I/M47V/A71D, A71D/L72V/E95K, E35D/A71D, E35D/I67L/A71D, T13R/M42V/M47I/A71D, E35D, E35D/M47I/L70M, E35D/A71D/L72V, E35D/M43L/L70M, A26P/E35D/M43I/L85Q/E88D, E35D/D46V/L85Q, M47V/I69F/A71D/V83I, H18Y/A26T/E35D/A71D/L85Q, E35D/M47L, E23D/M42V/M43I/I58V/L70R, V68M/L70M/A71D/E95K, N55I/T57I/I69F, E35D/M43I/A71D, T41S/T57I/L70R, V20I/A71D, E23G/A26S/E35D/T62N/A71D/L72V/L85M, V22L/E35D/M43L/A71G/D76H, A26E/E35D/M47L/L85Q, D46E/A71D, Y31H/E35D/T41S/V68L/K93R/R94W, A26E/Q33R/E35D/M47L/L85Q/K86E, A26E/Q33R/E35D/M47L/L85Q, E35D/M47L/L85Q, A26E/Q33L/E35D/M47L/L85Q, A26E/Q33L/E35D/M47L, H18Y/A26E/Q33L/E35D/M47L/L85Q, Q33L/E35D/M47I, H18Y/Q33L/E35D/M47I, Q33L/E35D/D46E/M47I, Q33R/E35D/D46E/M47I, H18Y/E35D/M47L, Q33L/E35D/M47V, Q33L/E35D/M47V/T79A, Q33L/E35D/T41S/M47V, Q33L/E35D/M47I/L85Q, Q33L/E35D/M47I/T62N/L85Q, Q33L/E35D/M47V/L85Q, A26E/E35D/M43T/M47L/L85Q/R94Q, Q33R/E35D/K37E/M47V/L85Q, V22A/E23D/Q33L/E35D/M47V, E24D/Q33L/E35D/M47V/K54R/L85Q, S15P/Q33L/E35D/M47L/L85Q, E7D/E35D/M47I/L97Q, Q33L/E35D/T41S/M43I, E35D/M47I/K54R/L85E, Q33K/E35D/D46V/L85Q, Y31S/E35D/M47L/T79L/E88G, H18L/V22A/E35D/M47L/N48T/L85Q, Q27H/E35D/M47L/L85Q/R94Q/E95K, Q33K/E35D/M47V/K89E/K93R, E35D/M47I/E77A/L85Q/R94W, A26E/E35D/M43I/M47L/L85Q/K86E/R94W, Q27H/Q33L/E35D/M47V/N55D/L85Q/K89N, H18Y/V20A/Q33L/E35D/M47V/Y53F, Q33L/E35D/M47L/A71G/F92S, V22A/R29H/E35D/D46E/M47I, Q33L/E35D/M43I/L85Q/R94W, H18Y/E35D/V68M/L97Q, Q33L/E35D/M47L/V68M/L85Q/E88D, Q33L/E35D/M43V/M47I/A71G, E35D/M47L/A71G/L97Q, E35D/M47V/A71G/L85M/L97Q, H18Y/Y31H/E35D/M47V/A71G/L85Q, E35D/D46E/M47V/L97Q, E35D/D46V/M47I/A71G/F92V, E35D/M47V/T62A/A71G/V83A/Y87H/L97M, Q33L/E35D/N48K/L85Q/L97Q, E35D/L85Q/K93T/E95V/L97Q, E35D/M47V/N48K/V68M/K89N, Q33L/E35D/M47I/N48D/A71G, Q27H/E35D/M47I/L85Q/D90G, E35D/M47I/L85Q/D90G, E35D/M47I/T62S/L85Q, A26E/E35D/M47L/A71G, E35D/M47I/Y87Q/K89E, V22A/E35D/M47I/Y87N, H18Y/A26E/E35D/M47L/L85Q/D90G, E35D/M47L/A71G/L85Q, E35D/M47V/A71G/E88D, E35D/A71G, E35D/M47V/A71G, I30V/E35D/M47V/A71G/A91V, V22D/E35D/M47L/L85Q, H18Y/E35D/N48K, E35D/T41S/M47V/A71G/K89N, E35D/M47V/N48T/L85Q, E35D/D46E/M47V/A71D/D90G, E35D/T41S/M43I/A71G/D90G, E35D/T41S/M43I/M47V/A71G, E35D/T41S/M43I/M47L/A71G, H18Y/V22A/E35D/M47V/T62S/A71G, H18Y/A26E/E35D/M47L/V68M/A71G/D90G, E35D/K37E/M47V/N48D/L85Q/D90N, Q27H/E35D/D46V/M47L/A71G, V22L/Q27H/E35D/M47I/A71G, E35D/D46V/M47L/V68M/L85Q/E88D, E35D/T41S/M43V/M47I/L70M/A71G, E35D/D46E/M47V/N63D/L85Q, E35D/D46E/M47V/V68M/D90G/K93E, E35D/M43I/M47V/K89N, E35D/M47L/A71G/L85M/F92Y, V22D/E35D/M47L/L70M/L97Q, E35D/T41S/M47V/L97Q, E35D/Y53H/A71G/D90G/L97R, Q33L/E35D/M43I/Y53F/T62S/L85Q, E35D/M38T/D46E/M47V/N48S, Q33R/E35D/M47V/N48K/L85M/F92L, E35D/M38T/M43V/M47V/N48R/L85Q, T28Y/Q33H/E35D/D46V/M47I/A71G, E35D/N48K/L72V, E35D/T41S/N48T, D46V/M47I/A71G, M47I/A71G, E35D/M43I/M47L/L85M, E35D/M43I/D46E/A71G/L85M, H18Y/E35D/M47L/A71G/A91S, E35D/M47I/N48K/I61F, E35D/M47V/T62S/L85Q, M43I/M47L/A71G, E35D/M47V, E35D/M47L/A71G/L85M, V22A/E35D/M47L/A71G, E35D/M47L/A71G, E35D/D46E/M47I, Q27H/E35D/M47I, E35D/D46E/L85M, E35D/D46E/A91G, E35D/D46E, E35D/L97R, H18Y/E35D, Q27L/E35D/M47V/I61V/L85M, E35D/M47V/I61V/L85M, E35D/M47V/L85M/R94Q, E35D/M47V/N48K/L85M, H18Y/E35D/M47V/N48K, A26E/Q27R/E35D/M47L/N48Y/L85Q, E35D/D46E/M47L/V68M/L85Q/F92L, E35D/M47I/T62S/L85Q/E88D, E24D/Q27R/E35D/T41S/M47V/L85Q, S15T/H18Y/E35D/M47V/T62A/N64S/A71G/L85Q/D90N, E35D/M47L/V68M/A71G/L85Q/D90G, H18Y/E35D/M47I/V68M/A71G/R94L, Q33R/M47V/T62N/A71G, H18Y/V22A/E35D/T41S/M47V/T62N/A71G/A91G, E24D/E35D/M47L/V68M/E95V/L97Q, E35D/D46E/M47I/T62A/V68M/L85M/Y87C, E35D/D46E/M47I/V68M/L85M, E35D/D46E/M47L/V68M/A71G/Y87C/K93R, E35D/D46E/M47L/V68M/T79M/L85M, E35D/D46E/M47L/V68M/T79M/L85M/L97Q, E35D/D46E/M47V/V68M/L85Q, E35D/M43I/M47L/V68M, E35D/M47I/V68M/Y87N, E35D/M47L/V68M/E95V/L97Q, E35D/M47L/Y53F/V68M/A71G/K93R/E95V, E35D/M47V/N48K/V68M/A71G/L85M, E35D/M47V/N48K/V68M/L85M, E35D/M47V/V68M/L85M, E35D/M47V/V68M/L85M/Y87D, E35D/T41S/D46E/M47I/V68M/K93R/E95V, H18Y/E35D/D46E/M47I/V68M/R94L, H18Y/E35D/D46E/M47I/V68M/R94L, H18Y/E35D/M38I/M47L/V68M/L85M, H18Y/E35D/M47I/V68M/Y87N, H18Y/E35D/M47I/V68M/Y87N, H18Y/E35D/M47L/V68M/A71G/L85M, H18Y/E35D/M47L/V68M/A71G/L85M, H18Y/E35D/M47L/V68M/E95V/L97Q, H18Y/E35D/M47L/V68M/E95V/L97Q, H18Y/E35D/M47L/Y53F/V68M/A71G, H18Y/E35D/M47L/Y53F/V68M/A71G, H18Y/E35D/M47L/Y53F/V68M/A71G/K93R/E95V, H18Y/E35D/M47L/Y53F/V68M/A71G/K93R/E95V, H18Y/E35D/M47V/V68M/L85M, H18Y/E35D/M47V/V68M/L85M, H18Y/E35D/V68M/A71G/R94Q/

E95V, H18Y/E35D/V68M/A71G/R94Q/E95V, H18Y/E35D/V68M/L85M/R94Q, H18Y/E35D/V68M/L85M/R94Q, H18Y/E35D/V68M/T79M/L85M, H18Y/V22D/E35D/M47V/N48K/V68M, Q27L/Q33L/E35D/T41S/M47V/N48K/V68M/L85M, Q33L/E35D/M47V/T62S/V68M/L85M, Q33R/E35D/M38I/M47L/V68M, R29C/E35D/M47L/V68M/A71G/L85M, S21P/E35D/K37E/D46E/M47I/V68M, S21P/E35D/K37E/D46E/M47I/V68M/R94L, T13R/E35D/M47L/V68M, T13R/Q27L/Q33L/E35D/T41S/M47V/N48K/V68M/L85M, T13R/Q33L/E35D/M47L/V68M/L85M, T13R/Q33L/E35D/M47V/T62S/V68M/L85M, T13R/Q33R/E35D/M38I/M47L/V68M, T13R/Q33R/E35D/M38I/M47L/V68M/E95V/L97Q, T13R/Q33R/E35D/M38I/M47L/V68M/L85M, T13R/Q33R/E35D/M38I/M47L/V68M/L85M/R94Q, T13R/Q33R/E35D/M47L/V68M, T13R/Q33R/E35D/M47L/V68M/L85M, V22D/E24D/E35D/M47L/V68M, V22D/E24D/E35D/M47L/V68M/L85M/D90G, V22D/E24D/E35D/M47V/V68M, H18Y/E35D/M47V/V68M/A71G, H18C/A26P/E35D/M47L/V68M/A71G, H18I/A26P/E35D/M47V/V68M/A71G, H18L/A26N/D46E/V68M/A71G/D90G, H18L/E35D/M47V/V68M/A71G/D90G, H18T/A26N/E35D/M47L/V68M/A71G, H18V/A26K/E35D/M47L/V68M/A71G, H18V/A26N/E35D/M47V/V68M/A71G, H18V/A26P/E35D/M47V/V68L/A71G, H18V/A26P/E35D/M47L/V68M/A71G, H18V/E35D/M47V/V68M/A71G/D90G, H18Y/A26P/E35D/M47I/V68M/A71G, H18Y/A26P/E35D/M47V/V68M/A71G, H18Y/E35D/M47V/V68L/A71G/D90G, H18Y/E35D/M47V/V68M/A71G/D90G, A26P/E35D/M47I/V68M/A71G/D90G, H18V/A26G/E35D/M47V/V68M/A71G/D90G, H18V/A26S/E35D/M47L/V68M/A71G/D90G, H18V/A26R/E35D/M47L/V68M/A71G/D90G, H18V/A26D/E35D/M47V/V68M/A71G/D90G, H18V/A26Q/E35D/M47V/V68L/A71G/D90G, H18A/A26P/E35D/M47L/V68M/A71G/D90G, H18A/A26N/E35D/M47L/V68M/A71G/D90G, H18F/A26P/E35D/M47I/V68M/A71G/D90G, H18F/A26H/E35D/M47L/V68M/A71G/D90G, H18F/A26N/E35D/M47V/V68M/A71G/D90K, H18Y/A26N/E35D/M47F/V68M/A71G/D90G, H18Y/A26P/E35D/M47Y/V68I/A71G/D90G, H18Y/A26Q/E35D/M47T/V68M/A71G/D90G, H18R/A26P/E35D/D46N/M47V/V68M/A71G/D90P, or H18F/A26D/E35D/D46E/M47T/V68M/A71G/D90G.

In some embodiments, the variant CD80 polypeptides provided herein, that exhibit increased affinity for the ectodomain of PD-L1, compared to a wild-type or unmodified CD80 polypeptide, can exhibit PD-L1-dependent CD28 costimulation or can effect PD-L1-dependent CD28 costimulatory activity. In some embodiments, wherein a variant CD80 polypeptide mediates or effects PD-L1-dependent CD28 costimulatory activity, the affinity of the variant CD80 polypeptide is increased at least 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold 60-fold, 70-fold, 80-fold, 90-fold, 100-fold, 150-fold, 200-fold, 250-fold, 300-fold, 350-fold, 400-fold, or 450-fold compared to binding affinity of the unmodified CD80 for the ectodomain of PD-L1.

In some embodiments, the variant CD80 polypeptides provided herein that exhibit, mediate, or effect PD-L1-dependent CD28 costimulatory activity, retain binding to the ectodomain of CD28 compared to a wild-type or unmodified CD80. For example the variant CD80 polypeptide can retain at least or about at least 2%, 3%, 4%, 5%, 6%, 7%, 8,%, 9%, 10%, 12%, 15%, 20%, 25%, 30%, 35%, 40%, 50%, 55%, 60%, 65%, 70% 75%, 80%, 85%, 90%, or 95% of the affinity to the ectodomain of CD28, compared to the binding affinity of the unmodified CD80 polypeptide for the ectodomain of CD28.

In some embodiments, the variant CD80 polypeptides provided herein that exhibit, mediate, or effect PD-L1-dependent CD28 costimulatory activity exhibit increased affinity to the ectodomain of CD28, compared to the binding affinity of the unmodified CD80 for the ectodomain of CD28. For example, the variant CD80 polypeptide can exhibit increased affinity to the ectodomain of CD28 that is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100-fold, 150-fold, or 200-fold, compared to binding affinity of the unmodified CD80 for the ectodomain of CD28.

III. Format of Variant Polypeptides

The immunomodulatory polypeptide comprising a variant CD80 provided herein in which is contained a vIgD can be formatted in a variety of ways, including as a soluble protein, membrane bound protein or secreted protein. In some embodiments, the particular format can be chosen for the desired therapeutic application. In some cases, an immunomodulatory polypeptide comprising a variant CD80 polypeptide is provided in a format to antagonize or block activity of its binding partner, e.g., CTLA-4, CD28, and/or PD-L1. In some embodiments, antagonism of CTLA-4 or PD-L1/PD-1 may be useful to promote immunity in oncology. In some cases, an immunomodulatory polypeptide comprising a variant CD80 polypeptide is provided in a format to agonize or stimulate activity of its binding partner, e.g., CTLA-4 and/or CD28. In some embodiments, agonism of CD28 may be useful to promote immunity in oncology. In some embodiments, agonism of CD28 can be dependent on or enhanced by CD80 binding of PD-L1. Such PD-L1-dependent agonism of CD28 may be useful to promote immunity in oncology. In some embodiments, agonism of CTLA-4 may be useful for treating inflammation or autoimmunity. A skilled artisan can readily determine the activity of a particular format, such as for antagonizing or agonizing one or more specific binding partner. Exemplary methods for assessing such activities are provided herein, including in the examples.

In some aspects, provided are immunomodulatory proteins comprising a vIgD of CD80 in which such proteins are soluble, e.g., fused to an Fc chain. In some aspects, one or more additional IgSF domain, such as one or more additional vIgD, may be linked to a vIgD of CD80 as provided herein (hereinafter called a "stack" or "stacked" immunomodulatory protein). In some embodiments, the modular format of the provided immunomodulatory proteins provides flexibility for engineering or generating immunomodulatory proteins for modulating activity of multiple counterstructures (multiple cognate binding partners). In some embodiments, such "stack" molecules can be provided in a soluble format or, in some cases, may be provided as membrane bound or secreted proteins. In some embodiments, a variant CD80 immunomodulatory protein is provided as a conjugate in which is contained a vIgD of CD80 linked, directly or indirectly, to a targeting agent or moiety, e.g., to an antibody or other binding molecules that specifically binds to a ligand, e.g., an antigen, for example, for targeting or localizing the vIgD to a specific environment or cell, such as when administered to a subject. In some embodiments, the targeting agent, e.g., antibody or other binding molecule, binds to a tumor antigen, thereby localizing the variant CD80 containing the vIgD to the tumor microenvironment, for example, to modulate activity of tumor infiltrating lymphocytes (TILs) specific to the tumor microenvironment.

In some embodiments, provided immunomodulatory proteins are expressed in cells and provided as part of an engineered cellular therapy (ECT). In some embodiments, the variant CD80 polypeptide is expressed in a cell, such as an immune cell (e.g., T cell or antigen presenting cell), in membrane-bound form, thereby providing a transmembrane immunomodulatory protein (hereinafter also called a "TIP"). In some embodiments, depending on the cognate binding partner recognized by the TIP, engineered cells expressing a TIP can agonize a cognate binding partner by providing a costimulatory signal, either positive to negative, to other engineered cells and/or to endogenous T cells. In some aspects, the variant CD80 polypeptide is expressed in a cell, such as an immune cell (e.g., T cell or antigen presenting cell), in secretable form to thereby produce a secreted or soluble form of the variant CD80 polypeptide (hereinafter also called a "SIP"), such as when the cells are administered to a subject. In some aspects, a SIP can antagonize a cognate binding partner in the environment (e.g., tumor microenvironment) in which it is secreted. In some embodiments, a variant CD80 polypeptide is expressed in an infectious agent (e.g., viral or bacterial agent) which, upon administration to a subject, is able to infect a cell in vivo, such as an immune cell (e.g., T cell or antigen presenting cell), for delivery or expression of the variant polypeptide as a TIP or a SIP in the cell.

In some embodiments, a soluble immunomodulatory polypeptide, such as a variant CD80 containing a vIgD, can be encapsulated within a liposome which itself can be conjugated to any one of or any combination of the provided conjugates (e.g., a targeting moiety). In some embodiments, the soluble or membrane bound immunomodulatory polypeptides of the invention are deglycosylated. In more specific embodiments, the variant CD80 sequence is deglycosylated. In even more specific embodiments, the IgV and/or IgC (e.g., IgC2) domain or domains of the variant CD80 is deglycosylated.

Figure 1B:
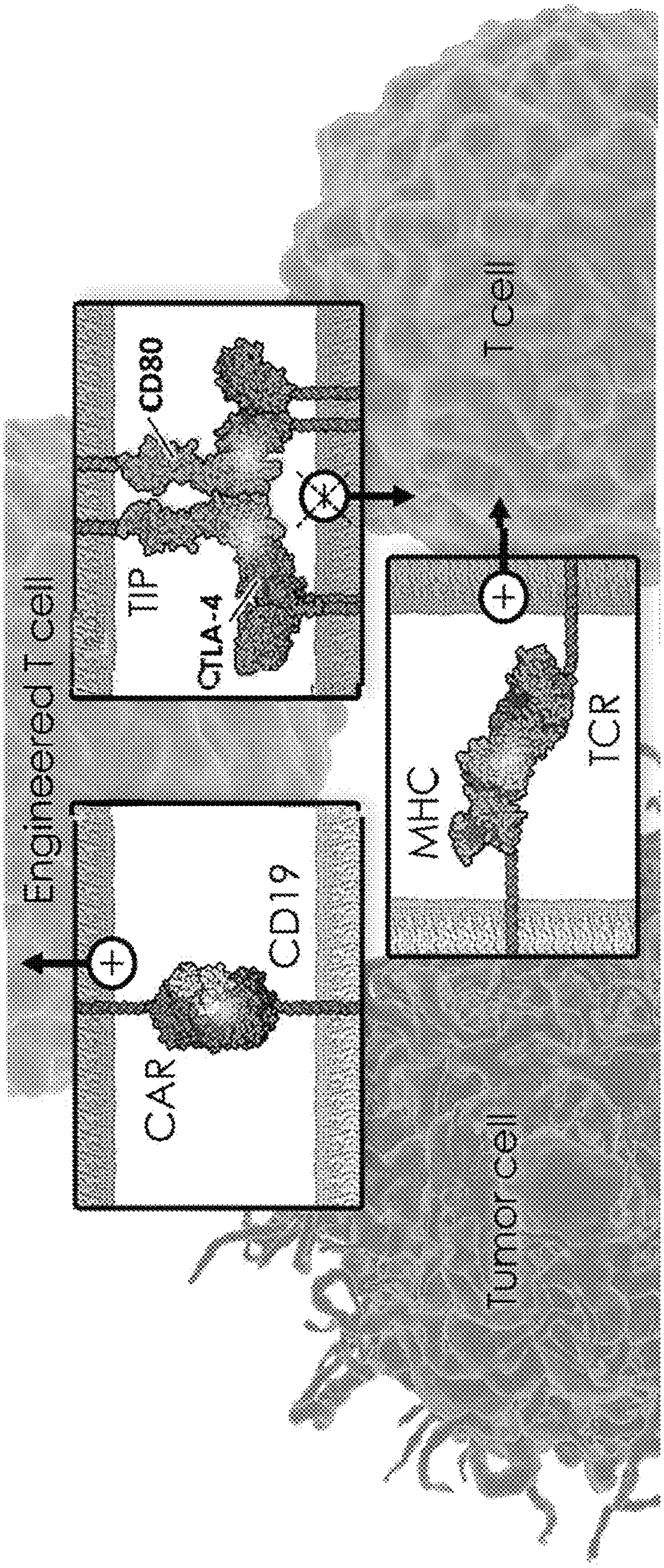
Figure 1C:
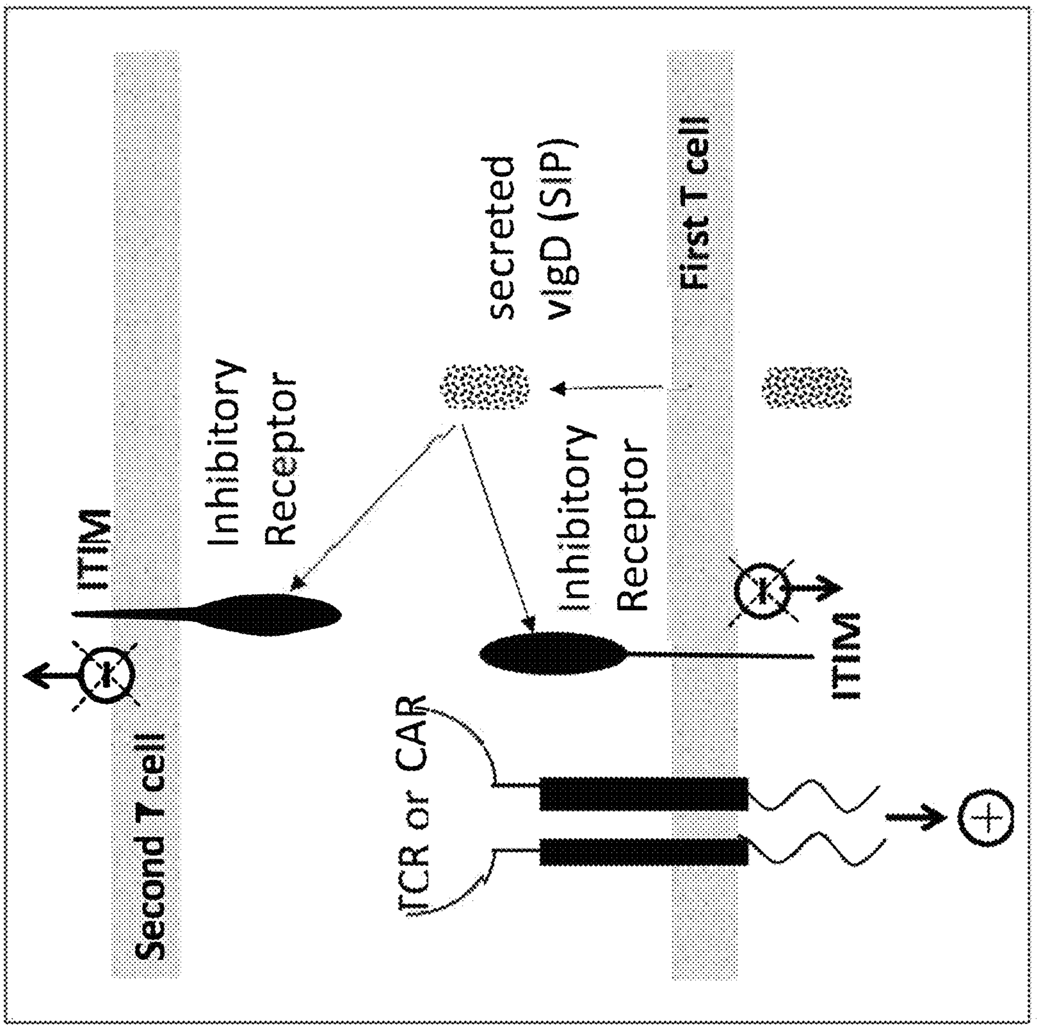

Non-limiting examples of provided formats are described in FIGS. 1A-1C and further described below.

A. Soluble Protein

In some embodiments, the immunomodulatory protein containing a variant CD80 polypeptide is a soluble protein. Those of skill will appreciate that cell surface proteins typically have an intracellular, transmembrane, and extracellular domain (ECD) and that a soluble form of such proteins can be made using the extracellular domain or an immunologically active subsequence thereof. Thus, in some embodiments, the immunomodulatory protein containing a variant CD80 polypeptide lacks a transmembrane domain or a portion of the transmembrane domain. In some embodiments, the immunomodulatory protein containing a variant CD80 lacks the intracellular (cytoplasmic) domain or a portion of the intracellular domain. In some embodiments, the immunomodulatory protein containing the variant CD80 polypeptide only contains the vIgD portion containing the ECD domain or a portion thereof containing an IgV domain and/or IgC (e.g., IgC2) domain or domains or specific binding fragments thereof containing the amino acid modification(s).

In some embodiments, an immunomodulatory polypeptide comprising a variant CD80 can include one or more variant CD80 polypeptides of the invention. In some embodiments a polypeptide of the invention will comprise exactly 1, 2, 3, 4, 5 variant CD80 sequences. In some embodiments, at least two of the variant CD80 sequences are identical variant CD80 sequences.

In some embodiments, the provided immunomodulatory polypeptide comprises two or more vIgD sequences of CD80. Multiple variant CD80 polypeptides within the polypeptide chain can be identical (i.e., the same species) to each other or be non-identical (i.e., different species) variant CD80 sequences. In addition to single polypeptide chain embodiments, in some embodiments two, three, four, or more of the polypeptides of the invention can be covalently or non-covalently attached to each other. Thus, monomeric, dimeric, and higher order (e.g., 3, 4, 5, or more) multimeric proteins are provided herein. For example, in some embodiments exactly two polypeptides of the invention can be covalently or non-covalently attached to each other to form a dimer. In some embodiments, attachment is made via interchain cysteine disulfide bonds. Compositions comprising two or more polypeptides of the invention can be of an identical species or substantially identical species of polypeptide (e.g., a homodimer) or of non-identical species of polypeptides (e.g., a heterodimer). A composition having a plurality of linked polypeptides of the invention can, as noted above, have one or more identical or non-identical variant CD80 polypeptides of the invention in each polypeptide chain.

In some embodiments, the immunomodulatory protein is or contains a variant CD80 polypeptide that is in monomer form and/or that exhibits monovalent binding to its binding partner. In some aspects, a variant CD80 polypeptide as described, such as a variant CD80 that is soluble and/or that lacks a transmembrane domain and intracellular signaling domain, is linked, directly or indirectly, to a further moiety. In some embodiments, the further moiety is a protein, peptide, small molecule or nucleic acid. In some embodiments, the monovalent immunomodulatory protein is a fusion protein. In some embodiments, the moiety is a half-life extending molecule. Examples of such half-life extending molecules include, but are not limited to, albumin, an albumin-binding polypeptide, Pro/Ala/Ser (PAS), a C-terminal peptide (CTP) of the beta subunit of human chorionic gonadotropin, polyethylene glycol (PEG), long unstructured hydrophilic sequences of amino acids (XTEN), hydroxyethyl starch (HES), an albumin-binding small molecule, or a combination thereof.

In some embodiments, the immunomodulatory polypeptide comprising a variant CD80 can be linked to a moiety that includes conformationally disordered polypeptide sequences composed of the amino acids Pro, Ala, and Ser (See e.g., WO2008/155134, SEQ ID NO: 904). In some cases, the amino acid repeat is at least 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid residues, wherein each repeat comprises (an) Ala, Ser, and Pro residue(s). Thus, provided herein is an immunomodulatory protein that is a PASylated protein wherein the variant CD80 polypeptide is linked, directly or indirectly via a linker, to Pro/Ala/Ser (PAS). In some embodiments, one or more additional linker structures may be used.

In some embodiments, the moiety facilitates detection or purification of the variant CD80 polypeptide. In some cases, the immunomodulatory polypeptide comprises a tag or fusion domain, e.g., affinity or purification tag, linked, directly or indirectly, to the N- and/or C-terminus of the CD80 polypeptide. Various suitable polypeptide tags and/or fusion domains are known, and include but are not limited to, a poly-histidine (His) tag, a FLAG-tag (SEQ ID NO:

3037), a Myc-tag, and fluorescent protein-tags (e.g., EGFP, set forth in SEQ ID NOs: 3033-3035). In some cases, the immunomodulatory polypeptide comprising a variant CD80 comprises at least six histidine residues (set forth in SEQ ID NO: 3038). In some cases, the immunomodulatory polypeptide comprising a variant CD80 further comprises various combinations of moieties. For example, the immunomodulatory polypeptide comprising a variant CD80 further comprises one or more polyhistidine-tag and FLAG tag.

In some embodiments, the CD80 polypeptide is linked to a modified immunoglobulin heavy chain constant region (Fc) that remains in monovalent form such as set forth in SEQ ID NO: 374.

In some embodiments, the immunomodulatory protein contains a variant CD80 polypeptide that is linked, directly or indirectly via a linker to a multimerization domain. In some aspects, the multimerization domain increases the half-life of the molecule. Interaction of two or more variant CD80 polypeptides can be facilitated by their linkage, either directly or indirectly, to any moiety or other polypeptide that are themselves able to interact to form a stable structure. For example, separate encoded variant CD80 polypeptide chains can be joined by multimerization, whereby multimerization of the polypeptides is mediated by a multimerization domain. Typically, the multimerization domain provides for the formation of a stable protein-protein interaction between a first variant CD80 polypeptide and a second variant CD80 polypeptide.

Homo- or heteromultimeric polypeptides can be generated from co-expression of separate variant CD80 polypeptides. The first and second variant CD80 polypeptides can be the same or different. In particular embodiments, the first and second variant CD80 polypeptides are the same in a homodimer, and each is linked to a multimerization domain that is the same. In other embodiments, heterodimers can be formed by linking first and second variant CD80 polypeptides that are different. In some of such embodiments, the first and second variant CD80 polypeptide are linked to different multimerization domains capable of promoting heterodimer formation.

In some embodiments, a multimerization domain includes any capable of forming a stable protein-protein interaction. The multimerization domains can interact via an immunoglobulin sequence (e.g. Fc domain; see e.g., International Patent Pub. Nos. WO 93/10151 and WO 2005/063816 US; U.S. Pub. No. 2006/0024298; U.S. Pat. No. 5,457,035); leucine zipper (e.g., from nuclear transforming proteins fos and jun or the proto-oncogene c-myc or from General Control of Nitrogen (GCN4)) (see e.g., Busch and Sassone-Corsi (1990) Trends Genetics, 6:36-40; Gentz et al., (1989) Science, 243:1695-1699); a hydrophobic region; a hydrophilic region; or a free thiol which forms an intermolecular disulfide bond between the chimeric molecules of a homo- or heteromultimer. In addition, a multimerization domain can include an amino acid sequence comprising a protuberance complementary to an amino acid sequence comprising a hole, such as is described, for example, in U.S. Pat. No. 5,731,168; International Patent Pub. Nos. WO 98/50431 and WO 2005/063816; Ridgway et al. (1996) Protein Engineering, 9:617-621. Such a multimerization region can be engineered such that steric interactions not only promote stable interaction, but further promote the formation of heterodimers over homodimers from a mixture of chimeric monomers. Generally, protuberances are constructed by replacing small amino acid side chains from the interface of the first polypeptide with larger side chains (e.g., tyrosine or tryptophan). Compensatory cavities of identical or similar size to the protuberances are optionally created on the interface of the second polypeptide by replacing large amino acid side chains with smaller ones (e.g., alanine or threonine). Exemplary multimerization domains are described below.

The variant CD80 polypeptide can be joined anywhere, but typically via its N- or C-terminus, to the N- or C-terminus of a multimerization domain to form a chimeric polypeptide. The linkage can be direct or indirect via a linker. The chimeric polypeptide can be a fusion protein or can be formed by chemical linkage, such as through covalent or non-covalent interactions. For example, when preparing a chimeric polypeptide containing a multimerization domain, nucleic acid encoding all or part of a variant CD80 polypeptide can be operably linked to nucleic acid encoding the multimerization domain sequence, directly or indirectly or optionally via a linker domain. In some cases, the construct encodes a chimeric protein where the C-terminus of the variant CD80 polypeptide is joined to the N-terminus of the multimerization domain. In some instances, a construct can encode a chimeric protein where the N-terminus of the variant CD80 polypeptide is joined to the C-terminus of the multimerization domain.

A polypeptide multimer contains multiple, such as two, chimeric proteins created by linking, directly or indirectly, two of the same or different variant CD80 polypeptides directly or indirectly to a multimerization domain. In some examples, where the multimerization domain is a polypeptide, a gene fusion encoding the variant CD80 polypeptide and multimerization domain is inserted into an appropriate expression vector. The resulting chimeric or fusion protein can be expressed in host cells transformed with the recombinant expression vector, and allowed to assemble into multimers, where the multimerization domains interact to form multivalent polypeptides. Chemical linkage of multimerization domains to variant CD80 polypeptides can be carried out using heterobifunctional linkers.

The resulting chimeric polypeptides, such as fusion proteins, and multimers formed therefrom, can be purified by any suitable method such as, for example, by affinity chromatography over Protein A or Protein G columns. Where two nucleic acid molecules encoding different polypeptides are transformed into cells, formation of homo- and heterodimers will occur. Conditions for expression can be adjusted so that heterodimer formation is favored over homodimer formation.

In some embodiments, the multimerization domain is an Fe domain or portions thereof from an immunoglobulin. In some embodiments, the immunomodulatory protein comprises a variant CD80 polypeptide attached to an immunoglobulin Fe (yielding an "immunomodulatory Fc fusion," such as a "variant CD80-Fc fusion," also termed a CD80 vIgD-Fc fusion). In some embodiments, the attachment of the variant CD80 polypeptide is at the N-terminus of the Fc. In some embodiments, the attachment of the variant CD80 polypeptide is at the C-terminus of the Fc. In some embodiments, two or more CD80 variant polypeptides (the same or different) are independently attached at the N-terminus and at the C-terminus.

In some embodiments, the Fe is murine or human Fc. In some embodiments, the Fe is a mammalian or human IgG1, IgG2, IgG3, or IgG4 Fc regions. In some embodiments, the Fe is derived from IgG1, such as human IgG1. In some embodiments, the Fc comprises the amino acid sequence set forth in SEQ ID NO: 277, 359, or 1712 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 277, 359, or 1712.

In some embodiments, the Fc region contains one more modifications to alter (e.g., reduce) one or more of its normal functions. In general, the Fc region is responsible for effector functions, such as complement-dependent cytotoxicity (CDC) and antibody-dependent cell cytotoxicity (ADCC), in addition to the antigen-binding capacity, which is the main function of immunoglobulins. Additionally, the FcRn sequence present in the Fc region plays the role of regulating the IgG level in serum by increasing the in vivo half-life by conjugation to an in vivo FcRn receptor. In some embodiments, such functions can be reduced or altered in an Fc for use with the provided Fc fusion proteins.

In some embodiments, one or more amino acid modifications may be introduced into the Fc region of a CD80-Fc variant fusion provided herein, thereby generating an Fc region variant. In some embodiments, the Fc region variant has decreased effector function. There are many examples of changes or mutations to Fe sequences that can alter effector function. For example, WO 00/42072, WO2006019447, WO2012125850, WO2015/107026, US2016/0017041 and Shields et al. *J Biol. Chem.* 9(2): 6591-6604 (2001) describe exemplary Fc variants with improved or diminished binding to FcRs. The contents of those publications are specifically incorporated herein by reference.

In some embodiments, the provided variant CD80-Fc fusions comprise an Fc region that exhibits reduced effector functions, which makes it a desirable candidate for applications in which the half-life of the CD80-Fc variant fusion in vivo is important yet certain effector functions (such as CDC and ADCC) are unnecessary or deleterious. In vitro and/or in vivo cytotoxicity assays can be conducted to confirm the reduction/depletion of CDC and/or ADCC activities. For example, Fc receptor (FcR) binding assays can be conducted to ensure that the CD80-Fc variant fusion lacks FcγR binding (hence likely lacking ADCC activity), but retains FcRn binding ability. The primary cells for mediating ADCC, NK cells, express FcγRIII only, whereas monocytes express FcγRI, FcγRII and FcγRIII. FcR expression on hematopoietic cells is summarized in Table 3 on page 464 of Ravetch and Kinet, *Annu. Rev. Immunol.* 9:457-492 (1991). Non-limiting examples of in vitro assays to assess ADCC activity of a molecule of interest is described in U.S. Pat. No. 5,500,362 (see, e.g., Hellstrom, I. et al. *Proc. Nat'l Acad. Sci. USA* 84:7059-7063 (1986)) and Hellstrom, I et al., *Proc. Nat'l Acad. Sci.* USA 82:1499-1502 (1985); U.S. Pat. No. 5,821,337 (see Bruggemann, M. et al., *J Exp. Med.* 166:1351-1361 (1987)). Alternatively, non-radioactive assay methods may be employed (see, for example, ACTI™ non-radioactive cytotoxicity assay for flow cytometry (CellTechnology, Inc. Mountain View, Calif.; and CytoTox 96™ non-radioactive cytotoxicity assay (Promega, Madison, Wis.). Useful effector cells for such assays include peripheral blood mononuclear cells (PBMC) and Natural Killer (NK) cells. Alternatively, or additionally, ADCC activity of the molecule of interest may be assessed in vivo, e.g., in an animal model such as that disclosed in Clynes et al. Proc. Nat'l *Acad. Sci.* USA 95:652-656 (1998). C1q binding assays may also be carried out to confirm that the CD80-Fc variant fusion is unable to bind C1q and hence lacks CDC activity. See, e.g., C1q and C3c binding ELISA in WO 2006/029879 and WO 2005/100402. To assess complement activation, a CDC assay may be performed (see, for example, Gazzano-Santoro et al., *J Immunol. Methods* 202:163 (1996); Cragg, M. S. et al., *Blood* 101:1045-1052 (2003); and Cragg, M. S. and M. J. Glennie, Blood 103:2738-2743 (2004)). FcRn binding and in vivo clearance/half-life determinations can also be performed using methods known in the art (see, e.g., Petkova, S. B. et al., *Int'l. Immunol.* 18(12):1759-1769 (2006)).

CD80-Fc variant fusions with reduced effector function include those with substitution of one or more of Fc region residues 238, 265, 269, 270, 297, 327 and 329 by EU numbering (U.S. Pat. No. 6,737,056). Such Fc mutants include Fc mutants with substitutions at two or more of amino acid positions 265, 269, 270, 297 and 327 by EU numbering, including the so-called "DANA" Fc mutant with substitution of residues 265 and 297 to alanine (U.S. Pat. No. 7,332,581).

In some embodiments, the Fc region of CD80-Fv variant fusions has an Fc region in which any one or more of amino acids at positions 234, 235, 236, 237, 238, 239, 270, 297, 298, 325, and 329 (indicated by EU numbering) are substituted with different amino acids compared to the native Fc region. Such alterations of Fc region are not limited to the above-described alterations, and include, for example, alterations such as deglycosylated chains (N297A and N297Q), IgG1-N297G, IgG1-L234A/L235A, IgG1-L234A/L235E/G237A, IgG1-A325A/A330S/P331S, IgG1-C226S/C229S, IgG1-C226S/C229S/E233P/L234V/L235A, IgG1-E233P/L234V/L235A/G236del/S267K, IgG1-L234F/L235E/P331S, IgG1-S267E/L328F, IgG2-V234A/G237A, IgG2-H268Q/V309L/A330S/A331S, IgG4-L235A/G237A/E318A, and IgG4-L236E described in Current Opinion in Biotechnology (2009) 20 (6), 685-691; alterations such as G236R/L328R, L235G/G236R, N325A/L328R, and N325LL328R described in WO 2008/092117; amino acid insertions at positions 233, 234, 235, and 237 (indicated by EU numbering); and alterations at the sites described in WO 2000/042072.

Certain Fc variants with improved or diminished binding to FcRs are described. (See, e.g., U.S. Pat. No. 6,737,056; WO 2004/056312, WO2006019447 and Shields et al., *J. Biol. Chem.* 9(2): 6591-6604 (2001).)

In some embodiments, there is provided a CD80-Fc variant fusion comprising a variant Fc region comprising one or more amino acid substitutions which increase half-life and/or improve binding to the neonatal Fc receptor (FcRn). Antibodies with increased half-lives and improved binding to FcRn are described in US2005/0014934A1 (Hinton et al.) or WO2015107026. Those antibodies comprise an Fc region with one or more substitutions therein which improve binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434 by EU numbering, e.g., substitution of Fc region residue 434 (U.S. Pat. No. 7,371,826).

In some embodiments, the Fc region of a CD80-Fc variant fusion comprises one or more amino acid substitution E356D and M358L by EU numbering. In some embodiments, the Fc region of a CD80-Fc variant fusion comprises one or more amino acid substitutions C220S, C226S and/or C229S by EU numbering. In some embodiments, the Fc region of a CD80 variant fusion comprises one or more amino acid substitutions R292C and V302C. See also Duncan & Winter, *Nature* 322:738-40 (1988); U.S. Pat. Nos. 5,648,260; 5,624,821; and WO 94/29351 concerning other examples of Fc region variants.

In some embodiments, alterations are made in the Fc region that result in diminished C1q binding and/or Complement Dependent Cytotoxicity (CDC), e.g., as described in U.S. Pat. No. 6,194,551, WO 99/51642, and Idusogie et al., *J. Immunol.* 164: 4178-4184 (2000).

In some embodiments, there is provided a CD80-Fc variant fusion comprising a variant Fc region comprising one or more amino acid modifications, wherein the variant Fc region is derived from IgG1, such as human IgG1. In some embodiments, the variant Fc region is derived from the amino acid sequence set forth in SEQ ID NO: 277. In some embodiments, the Fc contains at least one amino acid substitution that is N82G by numbering of SEQ ID NO: 277 (corresponding to N297G by EU numbering). In some embodiments, the Fc further contains at least one amino acid substitution that is R77C or V87C by numbering of SEQ ID NO: 277 (corresponding to R292C or V302C by EU numbering). In some embodiments, the variant Fc region further comprises a C5S amino acid modification by numbering of SEQ ID NO: 277 (corresponding to C220S by EU numbering), such as the Fc region set forth in SEQ ID NO: 1429. For example, in some embodiments, the variant Fc region comprises the following amino acid modifications: V297G and one or more of the following amino acid modifications C220S, R292C or V302C by EU numbering (corresponding to N82G and one or more of the following amino acid modifications C5S, R77C or V87C with reference to SEQ ID NO:277), e.g., the Fc region comprises the sequence set forth in SEQ ID NO:356. In some embodiments, the variant Fc region comprises one or more of the amino acid modifications C220S, L234A, L235E or G237A, e.g., the Fc region comprises the sequence set forth in SEQ ID NO:357. In some embodiments, the variant Fc region comprises one or more of the amino acid modifications C220S, L235P, L234V, L235A, G236del or S267K, e.g., the Fc region comprises the sequence set forth in SEQ ID NO:358. In some embodiments, the variant Fc comprises one or more of the amino acid modifications C220S, L234A, L235E, G237A, E356D or M358L, e.g., the Fc region comprises the sequence set forth in SEQ ID NO:376.

In some embodiments, CD80-Fc variant fusion provided herein contains a variant CD80 polypeptide in accord with the description set forth in Section II above. In some embodiments, there is provided a CD80-Fc variant fusion comprising any one of the described variant CD80 polypeptide linked to a variant Fc region, wherein the variant Fc region is not a human IgG1 Fc containing the mutations R292C, N297G and V302C (corresponding to R77C, N82G and V87C with reference to wild-type human IgG1 Fc set forth in SEQ ID NO: xxx). In some embodiments, there is provided a CD80-Fc variant fusion comprising any one of the variant CD80 polypeptide linked to an Fc region or variant Fc region, wherein the variant CD80 polypeptide is not linked to the Fe with a linker consisting of three alanines.

In some embodiments, the Fc region lacks the C-terminal lysine corresponding to position 232 of the wild-type or unmodified Fc set forth in SEQ ID NO: 277 (corresponding to K447del by EU numbering). In some aspects, such an Fc region can additionally include one or more additional modifications, e.g., amino acid substitutions, such as any as described. Examples of such an Fc region are set forth in SEQ ID NO: 356-358, 376, or 1713-1715.

In some embodiments, there is provided a CD80-Fc variant fusion comprising a variant Fc region in which the variant Fc comprises the sequence of amino acids set forth in any of SEQ ID NOS:376, 356, 357, 358, 1429, or 1713-1715 or a sequence of amino acids that exhibits at least 85%, 86%, 87%, 88%, 89%, 90%, 91%, 92%, 93%, 94%, 95%, 96%, 97%, 98%, 99% or more sequence identity to any of SEQ ID NOS: 376, 356, 357, 358, 1429, or 1713-1715.

In some embodiments, the Fe is derived from IgG2, such as human IgG2. In some embodiments, the Fc comprises the amino acid sequence set forth in SEQ ID NO: 278 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 278.

In some embodiments, the Fc comprises the amino acid sequence set forth in SEQ ID NO: 1427 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1427. In some embodiments, the IgG4 Fe is a stabilized Fc in which the CH3 domain of human IgG4 is substituted with the CH3 domain of human IgG and which exhibits inhibited aggregate formation, an antibody in which the CH3 and CH2 domains of human IgG4 are substituted with the CH3 and CH2 domains of human IgG1, respectively, or an antibody in which arginine at position 409 indicated in the EU index proposed by Kabat et al. of human IgG4 is substituted with lysine and which exhibits inhibited aggregate formation (see e.g., U.S. Pat. No. 8,911,726. In some embodiments, the Fc is an IgG4 containing the S228P mutation, which has been shown to prevent recombination between a therapeutic antibody and an endogenous IgG4 by Fab-arm exchange (see e.g., Labrijin et al. (2009) Nat. Biotechnol., 27(8): 767-71). In some embodiments, the Fc comprises the amino acid sequence set forth in SEQ ID NO: 1428 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1428.

In some embodiments, the variant CD80 polypeptide is indirectly linked to the Fc sequence, such as via a linker. In some embodiments, one or more "peptide linkers" link the variant CD80 polypeptide and the Fc domain. In some embodiments, a peptide linker can be a single amino acid residue or greater in length. In some embodiments, the peptide linker has at least one amino acid residue but is no more than 20, 19, 18, 17, 16, 15, 14, 13, 12, 11, 10, 9, 8, 7, 6, 5, 4, 3, 2, or 1 amino acid residues in length. In some embodiments, the linker is a flexible linker. In some embodiments, the linker is (in one-letter amino acid code): GGGGS ("4GS" or "$G_4S$"; SEQ ID NO: 1717) or multimers of the 4GS linker, such as repeats of 2, 3, 4, or 5 4GS linkers, such as set forth in SEQ ID NO: 330 (2×GGGGS; $(G_4S)_2$) or SEQ ID NO: 329 (3×GGGGS; $(G_4S)_3$). In some embodiments, the linker can include a series of alanine residues alone or in addition to another peptide linker (such as a4GS linker or multimer thereof). In some embodiments, the number of alanine residues in each series is 2, 3, 4, 5, or 6 alanines. In some embodiments, the linker is three alanines (AAA). In some embodiments, the variant CD80 polypeptide is indirectly linked to the Fc sequence via a linker, wherein the linker doe not consist of three alanines. In some examples, the linker is a 2×GGGGS followed by three alanines (GGGGSGGGGSAAA; SEQ ID NO: 331). In some embodiments, the linker can further include amino acids introduced by cloning and/or from a restriction site, for example the linker can include the amino acids GS (in one-letter amino acid code) as introduced by use of the restriction site BAMHI. For example, in some embodiments, the linker (in one-letter amino acid code) is GSGGGGS (SEQ ID NO:1716), $GS(G_4S)_3$ (SEQ ID NO: 3028), or $GS(G_4S)_5$ (SEQ ID NO: 3029). In some embodiments, the linker is a rigid linker. For example, the linker is an α-helical linker. In some embodiments, the linker is (in one-letter amino acid code): EAAAK or multimers of the EAAAK linker, such as repeats of 2, 3, 4, or 5 EAAAK linkers, such as set forth in SEQ ID NO: 3026 (1×EAAAK), SEQ ID NO: 3027 (3×EAAAK), or SEQ ID NO: 3036 (5×EAAAK). In some cases, the immunomodulatory polypeptide comprising a variant CD80 comprises various combinations of peptide linkers.

In some embodiments, the variant CD80 polypeptide is directly linked to the Fc sequence. In some embodiments, the variant CD80 polypeptide is directly linked to an Fc, such as an inert Fc, that was additionally lacking all or a portion of the hinge region. An exemplary Fc, lacking a portion (6 amino acids) of the hinge region is set forth in SEQ ID NO: 3025. In some embodiments, where the CD80 polypeptide is directly linked to the Fc sequence, the CD80 polypeptide can be truncated at the C-terminus by 1, 2, 3, 4, 5, 6, 7, 8, 9, 10, 12, 13, 14, 15, or more amino acids. In some embodiments, the variant CD80 polypeptide is truncated to remove 1, 2, 3, 4, 5, 6, 7, 8, 9, 10, or more amino acids that connect the IgV region to the IgC region. For example, variant CD80 polypeptides can contain modifications in the exemplary wild-type CD80 backbone set forth in SEQ ID NO: 3030).

In some embodiments, the variant CD80-Fc fusion protein is a dimer formed by two variant CD80 Fc polypeptides linked to an Fc domain. In some specific embodiments, identical or substantially identical species (allowing for 3 or fewer N-terminus or C-terminus amino acid sequence differences) of CD80-Fc variant fusion polypeptides will be dimerized to create a homodimer. In some embodiments, the dimer is a homodimer in which the two variant CD80 Fc polypeptides are the same. Alternatively, different species of CD80-Fc variant fusion polypeptides can be dimerized to yield a heterodimer. Thus, in some embodiments, the dimer is a heterodimer in which the two variant CD80 Fc polypeptides are different.

Also provided are nucleic acid molecules encoding the variant CD80-Fc fusion protein. In some embodiments, for production of an Fc fusion protein, a nucleic acid molecule encoding a variant CD80-Fc fusion protein is inserted into an appropriate expression vector. The resulting variant CD80-Fc fusion protein can be expressed in host cells transformed with the expression where assembly between Fc domains occurs by interchain disulfide bonds formed between the Fc moieties to yield dimeric, such as divalent, variant CD80-Fc fusion proteins.

The resulting Fc fusion proteins can be easily purified by affinity chromatography over Protein A or Protein G columns. For the generation of heterodimers, additional steps for purification can be necessary. For example, where two nucleic acids encoding different variant CD80 polypeptides are transformed into cells, the formation of heterodimers must be biochemically achieved since variant CD80 molecules carrying the Fc-domain will be expressed as disulfide-linked homodimers as well. Thus, homodimers can be reduced under conditions that favor the disruption of interchain disulfides, but do no effect intra-chain disulfides. In some cases, different variant-CD80 Fc monomers are mixed in equimolar amounts and oxidized to form a mixture of homo- and heterodimers. The components of this mixture are separated by chromatographic techniques. Alternatively, the formation of this type of heterodimer can be biased by genetically engineering and expressing Fc fusion molecules that contain a variant CD80 polypeptide using knob-into-hole methods described below.

B. Stack Molecules with Additional IgSF Domains

In some embodiments, the immunomodulatory proteins can contain any of the variant CD80 polypeptides provided herein linked, directly or indirectly, to one or more other immunoglobulin superfamily (IgSF) domain ("stacked" immunomodulatory protein construct and also called a "Type II" immunomodulatory protein). In some aspects, this can create unique multi-domain immunomodulatory proteins that bind two or more, such as three or more, cognate binding partners, thereby providing a multi-targeting modulation of the immune synapse.

In some embodiments, an immunomodulatory protein comprises a combination (a "non-wild-type combination") and/or arrangement (a "non-wild type arrangement" or "non-wild-type permutation") of a variant CD80 domain with one or more other affinity modified and/or non-affinity modified IgSF domain sequences of another IgSF family member (e.g., a mammalian IgSF family member) that are not found in wild-type IgSF family members. In some embodiments, the immunomodulatory protein contains 2, 3, 4, 5 or 6 immunoglobulin superfamily (IgSF) domains, where at least one of the IgSF domains is a variant CD80 IgSF domain (vIgD of CD80) according to the provided description.

In some embodiments, the sequences of the additional IgSF domains can be a modified IgSF domain that contains one or more amino acid modifications, e.g., substitutions, compared to a wildtype or unmodified IgSF domain. In some embodiments, the IgSF domain can be non-affinity modified (e.g., wild-type) or have been affinity modified. In some embodiments, the unmodified or wild-type IgSF domain can be from mouse, rat, cynomolgus monkey, or human origin, or combinations thereof. In some embodiments, the additional IgSF domains can be an IgSF domain of an IgSF family member set forth in Table 2. In some embodiments, the additional IgSF domain can be an affinity-modified IgSF domain containing one or more amino acid modifications, e.g., substitutions, compared to an IgSF domain contained in an IgSF family member set forth in Table 2.

In some embodiments, the additional IgSF domain is an affinity or non-affinity modified IgSF domain contained in an IgSF family member of a family selected from Signal-Regulatory Protein (SIRP) Family, Triggering Receptor Expressed On Myeloid Cells Like (TREML) Family, Carcinoembryonic Antigen-related Cell Adhesion Molecule (CEACAM) Family, Sialic Acid Binding Ig-Like Lectin (SIGLEC) Family, Butyrophilin Family, B7 family, CD28 family, V-set and Immunoglobulin Domain Containing (VSIG) family, V-set transmembrane Domain (VSTM) family, Major Histocompatibility Complex (MHC) family, Signaling lymphocytic activation molecule (SLAM) family, Leukocyte immunoglobulin-like receptor (LIR), Nectin (Nec) family, Nectin-like (NECL) family, Poliovirus receptor related (PVR) family, Natural cytotoxicity triggering receptor (NCR) family, T cell immunoglobulin and mucin (TIM) family or Killer-cell immunoglobulin-like receptors (KIR) family. In some embodiments, the additional IgSF domains are independently derived from an IgSF protein selected from the group consisting of CD80(B7-1), CD86 (B7-2), CD274 (PD-L1, B7-H1), PDCD1LG2(PD-L2, CD273), ICOSLG(B7RP1, CD275, ICOSL, B7-H2), CD276(B7-H3), VTCN1(B7-H4), CD28, CTLA4, PDCD1 (PD-1), ICOS, BTLA(CD272), CD4, CD8A(CD8-alpha), CD8B(CD8-beta), LAG3, HAVCR2(TIM-3), CEACAMI, TIGIT, PVR(CD155), PVRL2(CD112), CD226, CD2, CD160, CD200, CD200R1(CD200R), and NC R3 (NKp30).

The first column of Table 2 provides the name and, optionally, the name of some possible synonyms for that particular IgSF member. The second column provides the protein identifier of the UniProtKB database, a publicly available database accessible via the internet at uniprot.org or, in some cases, the GenBank Number. The Universal Protein Resource (UniProt) is a comprehensive resource for protein sequence and annotation data. The UniProt databases include the UniProt Knowledgebase (UniProtKB). UniProt is a collaboration between the European Bioinformatics Institute (EMBL-EBI), the SIB Swiss Institute of Bioinformatics and the Protein Information Resource (PIR) and supported mainly by a grant from the U.S. National Institutes of Health (NIH). GenBank is the NIH genetic sequence database, an annotated collection of all publicly available DNA sequences (Nucleic Acids Research, 2013 January; 41(D1):D36-42). The third column provides the region where the indicated IgSF domain is located. The region is specified as a range where the domain is inclusive of the residues defining the range. Column 3 also indicates the IgSF domain class for the specified IgSF region. Column 4 provides the region where the indicated additional domains are located (signal peptide, S; extracellular domain, E; transmembrane domain, T; cytoplasmic domain, C). Itis understood that description of domains can vary depending on the methods used to identify or classify the domain, and may be identified differently from different sources. The description of residues corresponding to a domain in Table 2 is for exemplification only and can be several amino acids (such as one, two, three or four) longer or shorter. Column 5 indicates for some of the listed IgSF members, some of its cognate cell surface binding partners.

TABLE 2

IgSF members according to the present disclosure.

| IgSF Member (Synonym) | NCBI Protein Accession Number/ UniProtKB Protein Identifier | IgSF Region & Domain Class | Other Domains | Cognate Cell Surface Binding Partners | IgSF Member Amino Acid Sequence (SEQ ID NO) Precursor (mature residues) | Mature | ECD |
|---|---|---|---|---|---|---|---|
| CD80 (B7-1) | NP_005182.1 P33681 | 35-135, 35-138, 37-138, or 35-141 IgV, 145-230, 154- 232, or 142-232 IgC | S: 1-34, E: 35-242, T: 243-263, C: 264-288 | CD28, CTLA4, PD-L1 | 1 (35-288) | 279 | 2 |
| CD86 (B7-2) | P42081.2 | 33-131 IgV, 150-225 IgC2 | S: 1-23, E: 24-247, T: 248-268, C: 269-329 | CD28, CTLA4 | 224 (24-329) | 280 | 250 |
| CD274 (PD-L1, B7-H1) | Q9NZQ7.1 | 19-127, 24-130 IgV, 133-225 IgC2 | S: 1-18, E: 19-238, T: 239-259, C: 260-290 | PD-1, B7-1 | 225 (19-290) | 281 | 251 |
| PDCD1L G2 (PD-L2, CD273) | Q9BQ51.2 | 21-118 IgV, 122-203 IgC2 | S: 1-19, E: 20-220, T: 221-241, C: 242-273 | PD-1, RGMb | 226 (20-273) | 282 | 252 |
| ICOSLG (B7RP1, CD275, ICOSL, B7-H2) | O75144.2 | 19-129 IgV, 141-227 IgC2 | S: 1-18, E: 19-256, T: 257-277, C: 278-302 | ICOS, CD28, CTLA4 | 227 (19-302) | 283 | 253 |
| CD276 (B7-H3) | Q5ZPR3.1 | 29-139 IgV, 145-238 IgC2, 243-357 IgV2, 363-456, 367-453 IgC2 | S: 1-28, E: 29-466, T: 467-487, C: 488-534 | | 228 (29-534) | 284 | 254 |
| VTCN1 (B7-H4) | Q7Z7D3.1 | 35-146 IgV, 153-241 IgV | S: 1-24, E: 25-259, T: 260-280, C: 281-282 | | 229 (25-282) | 285 | 255 |
| CD28 | P10747.1 | 28-137 IgV | S: 1-18, E: 19-152, T: 153-179, C: 180-220 | B7-1, B7-2, B7RP1 | 230 (19-220) | 286 | 256 |
| CTLA4 | P16410.3 | 39-140 IgV | S: 1-35, E: 36-161, T: 162-182, C: 183-223 | B7-1, B7-2, B7RP1 | 231 (36-223) | 287 | 257 |
| PDCD1 (PD-1) | Q15116.3 | 35-145 IgV | S: 1-20, E: 21-170, T: 171-191, C: 192-288 | PD-L1, PD-L2 | 232 (21-288) | 288 | 258 |
| ICOS | Q9Y6W8.1 | 30-132 IgV | S: 1-20, E: 21-140, T: 141-161, C: 162-199 | B7RP1 | 233 (21-199) | 289 | 259 |

TABLE 2-continued

IgSF members according to the present disclosure.

| IgSF Member (Synonym) | NCBI Protein Accession Number/ UniProtKB Protein Identifier | IgSF Region & Domain Class | Other Domains | Cognate Cell Surface Binding Partners | IgSF Member Amino Acid Sequence (SEQ ID NO) Precursor (mature residues) | Mature | ECD |
|---|---|---|---|---|---|---|---|
| BTLA (CD272) | Q7Z6A9.3 | 31-132 IgV | S: 1-30, E: 31-157, T: 158-178, C: 179-289 | HVEM | 234 (31-289) | 290 | 260 |
| CD4 | P01730.1 | 26-125 IgV, 126-203 IgC2, 204-317 IgC2, 317-389, 318-374 IgC2 | S: 1-25, E: 26-396, T: 397-418, C: 419-458 | MHC class II | 235 (26-458) | 291 | 261 |
| CD8A (CD8-alpha) | P01732.1 | 22-135 IgV | S: 1-21, E: 22-182, T: 183-203, C: 204-235 | MHC class I | 236 (22-235) | 292 | 262 |
| CD8B (CD8-beta) | P10966.1 | 22-132 IgV | S: 1-21, E: 22-170, T: 171-191, C: 192-210 | MHC class I | 237 (22-210) | 293 | 263 |
| LAG3 | P18627.5 | 37-167 IgV, 168-252 IgC2, 265-343 IgC2, 349-419 IgC2 | S: 1-28, E: 29-450, T: 451-471, C: 472-525 | MHC class II | 238 (29-525) | 294 | 264 |
| HAVCR2 (TIM-3) | Q8TDQ0.3 | 22-124 IgV | S: 1-21, E: 22-202, T: 203-223, C: 224-301 | CEACAM-1, phosphatidylserine, Galectin-9, HMGB1 | 239 (22-301) | 295 | 265 |
| CEACAM1 | P13688.2 | 35-142 IgV, 145-232 IgC2, 237-317 IgC2, 323-413 IgC2 | S: 1-34, E: 35-428, T: 429-452, C: 453-526 | TIM-3 | 240 (35-526) | 296 | 266 |
| TIGIT | Q495A1.1 | 22-124 IgV | S: 1-21, E: 22-141, T: 142-162, C: 163-244 | CD155, CD112 | 241 (22-244) | 297 | 267 |
| PVR (CD155) | P15151.2 | 24-139 IgV, 145-237 IgC2, 244-328 IgC2 | S: 1-20, E: 21-343, T: 344-367, C: 368-417 | TIGIT, CD226, CD96, poliovirus | 242 (21-417) | 298 | 268 |
| PVRL2 (CD112) | Q92692.1 | 32-156 IgV, 162-256 IgC2, 261-345 IgC2 | S: 1-31, E: 32-360, T: 361-381, C: 382-538 | TIGIT, CD226, CD112R | 243 (32-538) | 299 | 269 |
| CD226 | Q15762.2 | 19-126 IgC2, 135-239 IgC2 | S: 1-18, E: 19-254, T: 255-275, C: 276-336 | CD155, CD112 | 244 (19-336) | 300 | 270 |
| CD2 | P06729.2 | 25-128 IgV, 129-209 IgC2 | S: 1-24, E: 25-209, T: 210-235, C: 236-351 | CD58 | 245 (25-351) | 301 | 271 |
| CD160 | O95971.1 | 27-122 IgV | N/A | HVEM, MHC family of proteins | 246 (27-159) | 302 | 272 |
| CD200 | P41217.4 | 31-141 IgV, 142-232 IgC2 | S: 1-30, E: 31-232, T: 233-259, C: 260-278 | CD200R | 247 (31-278) | 303 | 273 |
| CD200R1 (CD200R) | Q8TD46.2 | 53-139 IgV, 140-228 IgC2 | S: 1-28, E: 29-243, T: 244-264, C: 265-325 | CD200 | 248 (29-325) | 304 | 274 |
| NCR3 (NKp30) | O14931.1 | 19-126 IgC-like | S: 1-18, E: 19-135, T: 136-156, C: 157-201 | B7-H6 | 249 (19-201) | 305 | 275 |

TABLE 2-continued

| IgSF members according to the present disclosure. | | | | | | | |
|---|---|---|---|---|---|---|---|
| IgSF Member (Synonym) | NCBI Protein Accession Number/ UniProtKB Protein Identifier | IgSF Region & Domain Class | Other Domains | Cognate Cell Surface Binding Partners | IgSF Member Amino Acid Sequence (SEQ ID NO) Precursor (mature residues) | Mature | ECD |
| VSIG8 | Q5VU13 | 22-141 IgV1, 146-257 IgV2 | S: 1-21 E: 22-263 T: 264-284 C: 285-414 | VISTA | 306 (22-414) | 307 | 308 |

The number of such non-affinity modified or affinity modified IgSF domains present in a "stacked" immunomodulatory protein construct (whether non-wild type combinations or non-wild type arrangements) is at least 2, 3, 4, or 5 and in some embodiments exactly 2, 3, 4, or 5 IgSF domains (whereby determination of the number of affinity modified IgSF domains disregards any non-specific binding fractional sequences thereof and/or substantially immunologically inactive fractional sequences thereof).

In some embodiments of a stacked immunomodulatory protein provided herein, the number of IgSF domains is at least 2 wherein the number of affinity modified and the number of non-affinity modified IgSF domains is each independently at least: 0, 1, 2, 3, 4, 5, or 6. Thus, the number of affinity modified IgSF domains and the number of non-affinity modified IgSF domains, respectively, (affinity modified IgSF domain: non-affinity modified IgSF domain), can be exactly or at least: 2:0 (affinity modified: wild-type), 0:2, 2:1, 1:2, 2:2, 2:3, 3:2, 2:4, 4:2, 1:1, 1:3, 3:1, 1:4, 4:1, 1:5, or 5:1.

In some embodiments of a stacked immunomodulatory protein, at least two of the non-affinity modified and/or affinity modified IgSF domains are identical IgSF domains.

In some embodiments, a stacked immunomodulatory protein provided herein comprises at least two affinity modified and/or non-affinity modified IgSF domains from a single IgSF member but in a non-wild-type arrangement (alternatively, "permutation"). One illustrative example of a non-wild type arrangement or permutation is an immunomodulatory protein comprising a non-wild-type order of affinity modified and/or non-affinity modified IgSF domain sequences relative to those found in the wild-type CD80 whose IgSF domain sequences served as the source of the variant IgSF domains as provided herein. Thus, in one example, the immunomodulatory protein can comprise an IgV proximal and an IgC distal to the transmembrane domain albeit in a non-affinity modified and/or affinity modified form. The presence, in an immunomodulatory protein provided herein, of both non-wild-type combinations and non-wild-type arrangements of non-affinity modified and/or affinity modified IgSF domains, is also within the scope of the provided subject matter.

In some embodiments of a stacked immunomodulatory protein, the non-affinity modified and/or affinity modified IgSF domains are non-identical (i.e., different) IgSF domains. Non-identical affinity modified IgSF domains specifically bind, under specific binding conditions, different cognate binding partners and are "non-identical" irrespective of whether or not the wild-type or unmodified IgSF domains from which they are engineered was the same. Thus, for example, a non-wild-type combination of at least two non-identical IgSF domains in an immunomodulatory protein can comprise at least one IgSF domain sequence whose origin is from and unique to one CD80, and at least one of a second IgSF domain sequence whose origin is from and unique to another IgSF family member that is not CD80, wherein the IgSF domains of the immunomodulatory protein are in non-affinity modified and/or affinity modified form. However, in alternative embodiments, the two non-identical IgSF domains originate from the same IgSF domain sequence but at least one is affinity modified such that they specifically bind to different cognate binding partners.

In some embodiments, the provided immunomodulatory proteins, in addition to containing a variant CD80 polypeptide, also contains at least 1, 2, 3, 4, 5 or 6 additional immunoglobulin superfamily (IgSF) domains, such as an IgD domain of an IgSF family member set forth in Table 2. In some embodiments, the provided immunomodulatory protein contains at least one additional IgSF domain (e.g., second IgSF domain). In some embodiments, the provided immunomodulatory protein contains at least two additional IgSF domains (e.g., second and third IgSF domain). In some embodiments, the provided immunomodulatory protein contains at least three additional IgSF domains (e.g., second, third and fourth). In some embodiments, the provided immunomodulatory protein contains at least four additional IgSF domains (e.g., second, third, fourth and fifth). In some embodiments, the provided immunomodulatory protein contains at least five additional IgSF domains (e.g., second, third, fourth, fifth and sixth). In some embodiments, the provided immunomodulatory protein contains at least six additional IgSF domains (e.g., second, third, fourth, fifth, sixth and seventh). In some embodiments, each of the IgSF domains in the immunomodulatory protein are different. In some embodiments, at least one of the additional IgSF domains is the same as at least one other IgSF domain in the immunomodulatory protein. In some embodiments, each of the IgSF domains is from or derived from a different IgSF family member. In some embodiments, at least two of the IgSF domains is from or derived from the same IgSF family member.

In some embodiments, the additional IgSF domain comprises an IgV domain or an IgC (e.g., IgC2) domain or domains, or a specific binding fragment of the IgV domain or a specific binding fragment of the IgC (e.g., IgC2) domain or domains. In some embodiments, the additional IgSF domain is or comprises a full-length IgV domain. In some embodiments, the additional IgSF domain is or comprises a full-length IgC (e.g., IgC2) domain or domains. In some embodiments, the additional IgSF domain is or comprises a specific binding fragment of the IgV domain. In some embodiments, the additional IgSF domain is or comprises a specific binding fragment of the IgC (e.g., IgC2) domain or domains. In some embodiments, the immunomodulatory protein contains at least two additional IgSF domains from a single (same) IgSF member. For example, in some aspects, the immunomodulatory protein contains an ECD or portion thereof of an IgSF member containing a full-length IgV domain and a full-length IgC (e.g., IgC2) domain or domains or specific binding fragments thereof.

In some embodiments, the provided immunomodulatory proteins contains at least one additional IgSF domain (e.g., a second or, in some cases, also a third IgSF domain and so on) in which at least one additional or second IgSF domain is an IgSF domain set forth in a wild-type or unmodified IgSF domain or a specific binding fragment thereof contained in the sequence of amino acids set forth in any of SEQ ID NOS: 224-249 and 306. In some embodiments, the wild-type or unmodified IgSF domain is an IgV domain or an IgC domain, such as an IgC1 or IgC2 domain.

In some embodiments, the provided immunomodulatory proteins, in addition to containing a variant CD80 polypeptide, also contains at least one additional affinity-modified IgSF domain (e.g., a second or, in some cases, also a third affinity-modified IgSF domain and so on) in which at least one additional IgSF domain is a vIgD that contains one or more amino acid modifications (e.g., substitution, deletion or mutation) compared to an IgSF domain in a wild-type or unmodified IgSF domain, such as an IgSF domain in an IgSF family member set forth in Table 2. In some embodiments, the additional e.g., second or third, affinity-modified IgSF domain comprises at least 85%, 86%, 87%, 88%, 89%, 90%, 91%, 92%, 93%, 94%, 95%, 96%, 97%, 98%, 99% or more sequence identity to a wild-type or unmodified IgSF domain or a specific binding fragment thereof contained in the sequence of amino acids set forth in any of SEQ ID NOS: 224-249 and 306. In some embodiments, the wild-type or unmodified IgSF domain is an IgV domain or an IgC domain, such as an IgC1 or IgC2 domain. In some embodiments, the additional, e.g., second or third, IgSF domain is an affinity-modified IgV domain and/or IgC domain. In some embodiments, the one or more additional IgSF domain is an affinity-modified IgSF domain that contains an IgV domain and/or an IgC (e.g., IgC2) domain or domains, or a specific binding fragment of the IgV domain and/or a specific binding fragment of the IgC (e.g., IgC2) domain or domains, in which the IgV and/or IgC domain contains the amino acid modification(s) (e.g., substitution(s)). In some embodiments, the one or more additional affinity-modified IgSF domain contains an IgV domain containing the amino acid modification(s) (e.g., substitution(s)). In some embodiments, the one or more additional affinity-modified IgSF domain include IgSF domains present in the ECD or a portion of the ECD of the corresponding unmodified IgSF family member, such as a full-length IgV domain and a full-length IgC (e.g., IgC2) domain or domains, or specific binding fragments thereof, in which one or both of the IgV and IgC contain the amino acid modification(s) (e.g., substitution(s)).

In some embodiments, the provided immunomodulatory protein contains at least one additional or second IgSF domain that is a vIgD that contains one or more amino acid substitutions compared to an IgSF domain (e.g., IgV) of a wild-type or unmodified IgSF domain other than CD80.

In some embodiments, the one or more additional IgSF domain (e.g., second or third IgSF) domain is an IgSF domain (e.g., IgV) of another IgSF family member that itself also binds to an inhibitory receptor. In some aspects, the one or more additional IgSF domain (e.g., second or third IgSF) domain is an affinity-modified IgSF domain that is a variant IgSF domain (vIgD) of an IgSF family member that bind to an inhibitory receptor and that contains one or more amino acid substitutions in an IgSF domain (e.g., IgV), in which, in some cases, the one or more amino acid modifications result in increased binding to the inhibitory receptor. In some embodiments, the vIgD contains one or more amino acid modifications (e.g., substitutions, deletions or additions) in a wild-type or unmodified IgSF domain (e.g., IgV) of an IgSF family member that binds to an inhibitory receptor. In addition to CTLA-4, exemplary of such inhibitory receptors are PD-1, LAG3, TIGIT, TIM-3, or BTLA. In some embodiments, the one or more additional IgSF domain is from an IgSF family member selected from CD155, CD112, PD-L1, PD-L2, or CEACAMI. Thus, in some aspects, provided are multi-target checkpoint antagonists that target or block activity of more than one inhibitory receptor. In some embodiments, the immunomodulatory protein in a multi-target checkpoint antagonist that targets or blocks activity of at least two, three, four or more inhibitory receptors.

In some embodiments, there is provided an immunomodulatory protein containing any one of the variant CD80 polypeptides and one or more IgSF domain of an inhibitory receptor, such as a wild-type or unmodified inhibitory receptor. In some embodiments, there is provided an immunomodulatory protein containing any one of the variant CD80 polypeptides and one or more IgSF domain of CD112, e.g., wild-type or unmodified CD112, such as an IgV domain set forth in SEQ ID NO: 734 or 829 or an ECD or a portion thereof (containing the IgV and IgC domain or specific binding fragments thereof) set forth in SEQ ID NO: 269 or a portion thereof. In some embodiments, there is provided an immunomodulatory protein containing any one of the variant CD80 polypeptides and one or more IgSF domain of CD155, e.g., wild-type or unmodified CD155, such as an IgV domain set forth in SEQ ID NO:378 or 421 or an ECD or a portion thereof (containing the IgV and IgC domain or specific binding fragments thereof) set forth in SEQ ID NO:268 or a portion thereof. In some embodiments, there is provided an immunomodulatory protein containing any one of the variant CD80 polypeptides and one or more IgSF domain of PD-L1, e.g., wild-type or unmodified PD-L1, such as an IgV domain set forth in SEQ ID NO: 1000 or 1196 or an ECD or a portion thereof (containing the IgV and IgC domain or specific binding fragments thereof) set forth in SEQ ID NO: 251 or 1721 or a portion thereof. In some embodiments, there is provided an immunomodulatory protein containing any one of the variant CD80 polypeptides and one or more IgSF domain of PD-L2, e.g., wild-type or unmodified PD-L2, such as IgV domain set forth in SEQ ID NO: 1197 or 1257 or an ECD or a portion thereof (containing the IgV and IgC domain or specific binding fragments thereof) set forth in SEQ ID NO: 252 or a portion thereof.

In some embodiments, there is provided an immunomodulatory protein containing one or more additional IgSF domain (e.g., second or third IgSF) that is a vIgD of an IgSF family member that binds to an inhibitory receptor in which the one or more amino acid modifications in an IgSF domain (e.g., IgV) results in increased binding affinity of the vIgD, or a fusion or immunomodulatory protein containing the vIgD, for its inhibitory receptor cognate binding partner compared to the unmodified IgSF domain, such as binding affinity that is increased more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In some embodiments, the one or more amino acid modifications in an IgSF domain (e.g., IgV) results in increased selectivity of the vIgD, or a fusion or immunomodulatory protein containing the vIgD, for its inhibitory receptor compared to the unmodified IgSF domain. In some embodiments, the increased selectivity is a greater ratio of binding of the vIgD for the inhibitory receptor versus another cognate binding partner, such as a cognate binding partner that is not an inhibitory receptor, compared to the ratio of binding of the unmodified IgSF for the inhibitory receptor versus the another cognate binding partner. In some embodiments, the ratio is greater by at least or at least about 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold.

In some embodiments, the at least one additional (e.g., second or third) vIgD is an IgSF domain (e.g., IgV) of a variant CD112 polypeptide that contains one or more amino acid modifications (e.g., substitutions, deletions or additions) in the IgSF domain (e.g., IgV) compared to unmodified or wild-type CD112, which are IgSF family members that bind to the inhibitory receptor TIGIT. Exemplary amino acid modifications, such as substitutions, deletions or additions, in an IgSF domain (e.g., IgV or ECD containing IgV and IgC) of a variant CD112 polypeptide are set forth in Table 3. In some embodiments, there is provided an immunomodulatory protein containing any of the provided variant CD80 polypeptides and a variant CD112 polypeptide containing an IgV domain including any of the amino acid modifications set forth in Table 3, such as the IgV domain set forth in any of SEQ ID NOS: 782-828, 830-876, 918-999, 1454-1501 or an IgV domain that has at least 85%, 86%, 87%, 88%, 89%, 90%, 91%, 92%, 93%, 94%, 95%, 96%, 97%, 98%, 99% to any of SEQ ID NOS: 782-828, 830-876, 918-999, 1454-1501 and contains the one or more amino acid modifications. In some embodiments, there is provided an immunomodulatory protein containing any of the provided variant CD80 polypeptides and a variant CD112 polypeptide containing an ECD or a portion thereof containing the IgV and/or IgC domains, in which is contained any of the amino acid modifications set forth in Table 3, such as the ECD set forth in any of SEQ ID NOS: 735-781, 877-917, 1430-1453 or an ECD that contains at least 85%, 86%, 87%, 88%, 89%, 90%, 91%, 92%, 93%, 94%, 95%, 96%, 97%, 98%, 99% to any of SEQ ID NOS: 735-781, 877-917, 1430-1453 and contains the one or more amino acid modifications.

In some embodiments, the at least one additional (e.g., second or third) vIgD is an IgSF domain (e.g., IgV) of a variant CD155 polypeptide that contains one or more amino acid modifications (e.g., substitutions, deletions or additions) in the IgSF domain (e.g., IgV) compared to unmodified or wild-type CD155, which are IgSF family members that bind to the inhibitory receptor TIGIT. Exemplary amino acid modifications, such as substitutions, deletions or additions, in an IgSF domain (e.g., IgV or ECD containing IgV and IgC) of a variant CD155 polypeptide are set forth in Table 4. In some embodiments, there is provided an immunomodulatory protein containing any of the provided variant CD80 polypeptides and a variant CD155 polypeptide containing an IgV domain including any of the amino acid modifications set forth in Table 4, such as the IgV domain set forth in any of SEQ ID NOS: 400-420, 422-442, 540-733, 1502-1547, 1572, 1573, 1620-1711 or an IgV domain that has at least 85%, 86%, 87%, 88%, 89%, 90%, 91%, 92%, 93%, 94%, 95%, 96%, 97%, 98%, 99% to any of SEQ ID NOS: 400-420, 422-442, 540-733, 1502-1547, 1572, 1573, 1620-1711 and contains the one or more amino acid modifications. In some embodiments, there is provided an immunomodulatory protein containing any of the provided variant CD80 polypeptides and a variant CD155 polypeptide containing an ECD or a portion thereof containing the IgV and/or IgC domains, in which is contained any of the amino acid modifications set forth in Table 4, such as the ECD set forth in any of SEQ ID NOS: 379-399, 443-539, 1548-1571, 1574-1619 or an ECD that contains at least 85%, 86%, 87%, 88%, 89%, 90%, 91%, 92%, 93%, 94%, 95%, 96%, 97%, 98%, 99% to any of SEQ ID NOS: 379-399, 443-539, 1548-1571, 1574-1619 and contains the one or more amino acid modifications.

In some embodiments, the at least one additional (e.g., second or third) vIgD is an IgSF domain (e.g., IgV) of a variant PD-L1 polypeptide that contains one or more amino acid modifications (e.g., substitutions, deletions or additions) in the IgSF domain (e.g., IgV or ECD) compared to unmodified or wild-type PD-L1, which, in some aspects, result in increased binding to the inhibitory receptor PD-1. Exemplary amino acid modifications, such as substitutions, deletions or additions, in an IgSF domain (e.g., IgV or ECD containing IgV and IgC) of a variant PD-L1 polypeptide are set forth in Table 5. In some embodiments, there is provided an immunomodulatory protein containing any of the provided variant CD80 polypeptides and a variant PD-L1 polypeptide containing an IgV domain including any of the amino acid modifications set forth in Table 5, such as the IgV domain set forth in any of SEQ ID NOS: 1066-1195, 1719, 1720, 1901-1930 or an IgV domain that has at least 85%, 86%, 87%, 88%, 89%, 90%, 91%, 92%, 93%, 94%, 95%, 96%, 97%, 98%, 99% to any of SEQ ID NOS: 1066-1195, 1719, 1720, 1901-1930 and contains the one or more amino acid modifications. In some embodiments, there is provided an immunomodulatory protein containing any of the provided variant CD180 polypeptides and a variant PD-L1 polypeptide containing an ECD or a portion thereof containing the IgV and/or IgC domains, in which is contained any of the amino acid modifications set forth in Table 5, such as the ECD set forth in any of SEQ ID NOS: 1001-1065, 1718, 1722-1900, 1931-1996 or an ECD that contains at least 85%, 86%, 87%, 88%, 89%, 90%, 91%, 92%, 93%, 94%, 95%, 96%, 97%, 98%, 99% to any of SEQ ID NOS: 1001-1065, 1718, 1722-1900, 1931-1996 and contains the one or more amino acid modifications.

In some embodiments, the at least one additional (e.g., second or third) vIgD is an IgSF domain (e.g., IgV) of a variant PD-L2 polypeptide that contains one or more amino acid modifications (e.g., substitutions, deletions or additions) in the IgSF domain (e.g., IgV) compared to unmodified or wild-type PD-L2, which, in some aspects, result in increased binding to the inhibitory receptor PD-1. Exemplary amino acid modifications, such as substitutions, deletions or additions, in an IgSF domain (e.g., IgV or ECD containing IgV and IgC) of a variant PD-L2 polypeptide are set forth in Table 6. In some embodiments, there is provided an immunomodulatory protein containing any of the provided variant CD80 polypeptides and a variant PD-L2 polypeptide containing an IgV domain including any of the amino acid modifications set forth in Table 6, such as the IgV domain set forth in any of SEQ ID NOS: 1275-1325, 1327-1401, 1403-1426, or an IgV domain that has at least 85%, 86%, 87%, 88%, 89%, 90%, 91%, 92%, 93%, 94%, 95%, 96%, 97%, 98%, 99% to any of SEQ ID NOS: 1275-1325, 1327-1401, 1403-1426, and contains the one or more amino acid modifications. In some embodiments, there is provided an immunomodulatory protein containing any of the provided variant CD80 polypeptides and a variant PD-L2 polypeptide containing an ECD or a portion thereof containing the IgV and/or IgC domains, in which is contained any of the amino acid modifications set forth in Table 6, such as the ECD set forth in any of SEQ ID NOS: 1198-1248, 1250-1256, 1258-1274 or an ECD that contains at least 85%, 86%, 87%, 88%, 89%, 90%, 91%, 92%, 93%, 94%, 95%, 96%, 97%, 98%, 99% to any of SEQ ID NOS: 1198-1248, 1250-1256, 1258-1274 and contains the one or more amino acid modifications.

In some embodiments, an immunomodulatory protein provided herein that contains a an IgSF domain (e.g. IgV) of CD155, CD112, PD-L1, or PD-L2 or a variant of any of the foregoing is one in which is contained a variant CD80 polypeptide in accord with the description set forth in Section II above. In some embodiments, a provided immunomodulatory protein containing an IgSF domain (e.g. IgV) from CD155, CD112, PD-L1 or PD-L2 or a variant of any of the foregoing and an IgSF domain of a variant CD80 polypeptide is one in which the variant CD80 polypeptide does not contain amino acid modifications in an unmodified CD80 polypeptide set forth in SEQ ID NO:2, 76 or 150 in which the only amino acid modifications are L70PI30F/L70P, Q27H/T41S/A71D, I30T/L70R, T13R/C16R/L70Q/A71D, T57I, M431/C82R, V22L/M38V/M47T/A71D/L85M, I30V/T57I/L70P/A71D/A91T, V22I/L70M/A71D, N55D/L70P/E77G, T57A/I69T, N55D/K86M, L72P/T79I, L70P/F92S, T79P, E35D/M47I/L65P/D90N, L25S/E35D/M47I/D90N, S44P/I67T/P74S/E81G/E95D, A71D, T13A/I61N/A71D, E81K/A91S, A12V/M47V/L70M, K34E/T41A/L72V, T41S/A71D/V84A, E35D/A71D, E35D/M47I, K36R/G78A, Q33E/T41A, M47V/N48H, M47L/V68A, S44P/A71D, Q27H/M431/A71D/R73S, E24X/Q33R/K54N/T57I/167V/A71D, E35D/T57I/L70Q/A71D, M47I/E88D, M42I/I61V/A71D, P51A/A71D, H18Y/M47I/T57I/A71G, V20I/M47V/T57I/V84I, V20I/M47V/A71D, A71D/L72V/E95K, V22L/E35G/A71D/L72P, E35D/A71D, E35D/I67L/A71D, Q27H/E35G/A71D/L72P/T79I, T13R/M42V/M47I/A71D, E35D, E35D/M47I/L70M, E35D/A71D/L72V, E35D/M43L/L70M, A26P/E35D/M43I/L85Q/E88D, E35D/D46V/L85Q, Q27L/E35D/M47I/T57I/L70Q/E88D, M47V/I69F/A71D/V83I, E35D/T57A/A71D/L85Q, H18Y/A26T/E35D/A71D/L85Q, E35D/M47L, E23D/M42V/M43I/I58V/L70R, V68M/L70M/A71D/E95K, N55I/T57I/I69F, E35D/M43I/A71D, T41S/T57I/L70R, H18Y/A7ID/L72P/E88V, V20I/A71D, E23G/A26S/E35D/T62N/A71D/L72V/L85M, A12T/E24D/E35D/D46V/I61V/L72P/E95V, V22L/E35D/M43L/A71G/D76H, E35G/K54E/A71D/L72P, L70Q/A71D, A26E/E35D/M47L/L85Q, D46E/A71D, or Y31H/E35D/T41S/V68L/K93R/R94W. In some embodiments, the variant CD80 polypeptide is not the polypeptide set forth in SEQ ID NO: 3-75, 77-149 or 151-223.

In some embodiments, a provided immunomodulatory protein does not contain an IgSF domain from CD155 or a variant of either thereof. In some embodiments, a provided immunomodulatory protein does not contain an IgSF domain from CD112 or a variant of either thereof. In some embodiments, a provided immunomodulatory protein does not contain an IgSF domain from PD-L1 or a variant of either thereof. In some embodiments, a provided immunomodulatory protein does not contain an IgSF domain from PD-L2 or a variant of either thereof.

In some embodiments, the one or more additional IgSF domain (e.g., second or third IgSF) domain is an IgSF domain (e.g., IgV) of another IgSF family member that binds or recognizes a tumor antigen. In such embodiments, the IgSF family member serves as a tumor-localizing moiety, thereby bringing the vIgD of CD80 in close proximity to immune cells in the tumor microenvironment. In some embodiments, the additional IgSF domain (e.g., second IgSF) domain is an IgSF domain of NKp30, which binds or recognizes B7-H6 expressed on a tumor cell. In some embodiments, the at least one additional (e.g., second) IgSF domain, e.g., NKp30, is an affinity-modified IgSF domain or vIgD that contains one or more amino acid modifications (e.g., substitutions, deletions or additions). In some embodiments, the one or more amino acid modifications increase binding affinity and/or selectivity to B7-H6 compared to unmodified IgSF domain, e.g., NKp30, such as by at least or at least about 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. Exemplary amino acid modifications, such as substitutions, deletions or additions, in an IgSF domain (e.g., IgC-like or full ECD) of a variant NKp30 polypeptide are set forth in Table 7. Among the exemplary polypeptides is an NKp30 variant that contains the mutations L30V/A60V/S64P/S86G with reference to positions in the NKp30 extracellular domain corresponding to positions set forth in SEQ ID NO:275. In some embodiments, there is provided an immunomodulatory protein containing any of the provided variant CD80 polypeptides and a variant NKp30 polypeptide containing an IgC-like domain including any of the amino acid modifications set forth in Table 7, such as the IgC-like domain set forth in any of SEQ ID NOS: 344-348 or an IgV domain that has at least 85%, 86%, 87%, 88%, 89%, 90%, 91%, 92%, 93%, 94%, 95%, 96%, 97%, 98%, 99% to any of SEQ ID NOS: 344-348 and contains the one or more amino acid modifications. In some embodiments, there is provided an immunomodulatory protein containing any of the provided variant CD180 polypeptides and a variant NKp30 polypeptide containing an ECD or a portion thereof containing an IgSF domain or domains, in which is contained any of the amino acid modifications set forth in Table 7, such as the ECD set forth in any of SEQ ID NOS: 334-338 or an ECD that contains at least 85%, 86%, 87%, 88%, 89%, 90%, 91%, 92%, 93%, 94%, 95%, 96%, 97%, 98%, 99% to any of SEQ ID NOS: 334-338 and contains the one or more amino acid modifications.

In some embodiments, the at least one additional (e.g., second or third) vIgD is an IgSF domain (e.g., IgV) of a variant CD86 polypeptide that contains one or more amino acid modifications (e.g., substitutions, deletions or additions) in the IgSF domain (e.g., IgV) compared to unmodified or wild-type CD86, which, in some aspects, result in increased binding to its cognate binding partner. Exemplary amino acid modifications, such as substitutions, deletions or additions, in an IgSF domain (e.g., IgV or ECD containing IgV and IgC) of a variant CD86 polypeptide are set forth in Table 8. Among exemplary polypeptides include CD86 variants that contain the mutations Q35H/H90L/Q102H with reference to positions in the CD86 extracellular domain corresponding to positions set forth in SEQ ID NO:250. In some embodiments, there is provided an immunomodulatory protein containing any of the provided variant CD80 polypeptides and a variant CD86 polypeptide containing an IgV domain including any of the amino acid modifications set forth in Table 8, such as the IgV domain set forth in any of SEQ ID NOS: 350-353 or an IgV domain that has at least 85%, 86%, 87%, 88%, 89%, 90%, 91%, 92%, 93%, 94%, 95%, 96%, 97%, 98%, 99% to any of SEQ ID NOS: 350-353 and contains the one or more amino acid modifications. In some embodiments, there is provided an immunomodulatory protein containing any of the provided variant CD80 polypeptides and a variant CD86 polypeptide containing an ECD or a portion thereof containing the IgV and/or IgC domains, in which is contained any of the amino acid modifications set forth in Table 8, such as the ECD set forth in any of SEQ ID NOS: 339-342 or an ECD that contains at least 85%, 86%, 87%, 88%, 89%, 90%, 91%, 92%, 93%, 94%, 95%, 96%, 97%, 98%, 99% to any of SEQ ID NOS: 339-342 and contains the one or more amino acid modifications.

Tables 3-8 provide exemplary polypeptides containing one or more affinity-modified IgSF domains that can be used in stack constructs provided herein.

TABLE 3

Exemplary variant CD112 polypeptides

| Mutation(s) | ECD SEQ ID NO | IgV SEQ ID NO | |
|---|---|---|---|
| Wild-type | 269 | 734 | 829 |
| Y33H, A112V, G117D | 735 | 782 | 830 |
| V19A, Y33H, S64G, S80G, G98S, N106Y, A112V | 736 | 783 | 831 |
| L32P, A112V | 737 | 784 | 832 |
| A95V, A112I | 738 | 785 | 833 |
| P28S, A112V | 739 | 786 | 834 |
| P27A, T38N, V101A, A112V | 740 | 787 | 835 |
| S118F | 741 | 788 | 836 |
| R12W, H48Y, F54S, S118F | 742 | 789 | 837 |
| R12W, Q79R, S118F | 743 | 790 | 838 |
| T113S, S118Y | 744 | 791 | 839 |
| S118Y | 745 | 792 | 840 |
| N106I, S118Y | 746 | 793 | 841 |
| N106I, S118F | 747 | 794 | 842 |
| A95T, L96P, S118Y | 748 | 795 | 843 |
| Y33H, P67S, N106Y, A112V | 749 | 796 | 844 |
| N106Y, A112V | 750 | 797 | 845 |
| T18S, Y33H, A112V | 751 | 798 | 846 |
| P9S, Y33H, N47S, A112V | 752 | 799 | 847 |
| P42S, P67H, A112V | 753 | 800 | 848 |
| P27L, L32P, P42S, A112V | 754 | 801 | 849 |
| G98D, A112V | 755 | 802 | 850 |
| Y33H, S35P, N106Y, A112V | 756 | 803 | 851 |
| L32P, P42S, T100A, A112V | 757 | 804 | 852 |
| P27S, P45S, N106I, A112V | 758 | 805 | 853 |
| Y33H, N47K, A112V | 759 | 806 | 854 |
| Y33H, N106Y, A112V | 760 | 807 | 855 |
| K78R, D84G, A112V, F114S | 761 | 808 | 856 |
| Y33H, N47K, F54L, A112V | 762 | 809 | 857 |
| Y33H, A112V | 763 | 810 | 858 |
| A95V, A112V | 764 | 811 | 859 |
| R12W, A112V | 765 | 812 | 860 |
| R12W, P27S, A112V | 766 | 813 | 861 |
| Y33H, V51M, A112V | 767 | 814 | 862 |
| Y33H, A112V, S118T | 768 | 815 | 863 |
| Y33H, V101A, A112V, P115S | 769 | 816 | 864 |
| H24R, T38N, D43G, A112V | 770 | 817 | 865 |
| A112V | 771 | 818 | 866 |
| P27A, A112V | 772 | 819 | 867 |
| A112V, S118T | 773 | 820 | 868 |
| R12W, A112V, M122I | 774 | 821 | 869 |
| Q83K, N106Y, A112V | 775 | 822 | 870 |
| R12W, P27S, A112V, S118T | 776 | 823 | 871 |
| P28S, Y33H, A112V | 777 | 824 | 872 |
| P27S, Q90R, A112V | 778 | 825 | 873 |
| L15V, P27A, A112V, S118T | 779 | 826 | 874 |
| Y33H, N106Y, T108I, A112V | 780 | 827 | 875 |
| Y33H, P56L, V75M, V101M, A112V | 781 | 828 | 876 |
| N47K, Q79R, S118F | 877 | 918 | 959 |
| Q40R, P60T, A112V, S118T | 878 | 919 | 960 |
| F114Y, S118F | 879 | 920 | 961 |
| Y33H, K78R, S118Y | 880 | 921 | 962 |
| R12W, A46T, K66M, Q79R, N106I, T113A, S118F | 881 | 922 | 963 |
| Y33H, A112V, S118F | 882 | 923 | 964 |
| R12W, Y33H, N106I, S118F | 883 | 924 | 965 |
| L15V, Q90R, S118F | 884 | 925 | 966 |
| N47K, D84G, N106I, S118Y | 885 | 926 | 967 |
| L32P, S118F | 886 | 927 | 968 |
| Y33H, Q79R, A112V, S118Y | 887 | 928 | 969 |
| T18A, N106I, S118T | 888 | 929 | 970 |
| L15V, Y33H, N106Y, A112V, S118F | 889 | 930 | 971 |
| V37M, S118F | 890 | 931 | 972 |
| N47K, A112V, S118Y | 891 | 932 | 973 |
| A46T, A112V | 892 | 933 | 974 |
| P28S, Y33H, N106I, S118Y | 893 | 934 | 975 |
| P30S, Y33H, N47K, V75M, Q79R, N106I, S118Y | 894 | 935 | 976 |
| V19A, N47K, N106Y, K116E, S118Y | 895 | 936 | 977 |

TABLE 3-continued

| Exemplary variant CD112 polypeptides | | | |
|---|---|---|---|
| Mutation(s) | ECD SEQ ID NO | IgV SEQ ID NO | |
| Q79R, T85A, A112V, S118Y | 896 | 937 | 978 |
| V101M, N106I, S118Y | 897 | 938 | 979 |
| Y33H, Q79R, N106I, A112V, S118T | 898 | 939 | 980 |
| Q79R, A112V | 899 | 940 | 981 |
| Y33H, A46T, Q79R, N106I, S118F | 900 | 941 | 982 |
| A112V, G121S | 901 | 942 | 983 |
| Y33H, Q79R, N106I, S118Y | 902 | 943 | 984 |
| Y33H, N106I, A112V | 903 | 944 | 985 |
| Y33H, A46T, V101M, A112V, S118T | 904 | 945 | 986 |
| L32P, L99M, N106I, S118F | 905 | 946 | 987 |
| L32P, T108A, S118F | 906 | 947 | 988 |
| R12W, Q79R, A112V | 907 | 948 | 989 |
| Y33H, N106Y, E110G, A112V | 908 | 949 | 990 |
| Y33H, N106I, S118Y | 909 | 950 | 991 |
| Q79R, S118F | 910 | 951 | 992 |
| Y33H, Q79R, G98D, V101M, A112V | 911 | 952 | 993 |
| N47K, T81S, V101M, A112V, S118F | 912 | 953 | 994 |
| G82S, S118Y | 913 | 954 | 995 |
| Y33H, A112V, S118Y | 914 | 955 | 996 |
| Y33H, N47K, Q79R, N106Y, A112V | 915 | 956 | 997 |
| Y33H, S118T | 916 | 957 | 998 |
| R12W, Y33H, Q79R, V101M, A112V | 917 | 958 | 999 |
| Y33H, Q83K, A112V, S118T | 1430 | 1454 | 1478 |
| V29M, Y33H, N106I, S118F | 1431 | 1455 | 1479 |
| Y33H, A46T, A112V | 1432 | 1456 | 1480 |
| Y33H, Q79R, S118F | 1433 | 1457 | 1481 |
| Y33H, N47K, F74L, S118F | 1434 | 1458 | 1482 |
| R12W, V101M, N106I, S118Y | 1435 | 1459 | 1483 |
| A46T, V101A, N106I, S118Y | 1436 | 1460 | 1484 |
| N106Y, A112V, S118T | 1437 | 1461 | 1485 |
| S76P, T81I, V101M, N106Y, A112V, S118F | 1438 | 1462 | 1486 |
| P9R, L21V, P22L, I34M, S69F, F74L, A87V, A112V, L125A | 1439 | 1463 | 1487 |
| Y33H, V101M, A112V | 1440 | 1464 | 1488 |
| V29A, L32P, S118F | 1441 | 1465 | 1489 |
| Y33H, V101M, N106I, A112V | 1442 | 1466 | 1490 |
| R12W, Y33H, N47K, Q79R, S118Y | 1443 | 1467 | 1491 |
| Y33H, A46T, A112V, S118T | 1444 | 1468 | 1492 |
| Y33H, A112V, F114L, S118T | 1445 | 1469 | 1493 |
| Y33H, T38A, A46T, V101M, A112V | 1446 | 1470 | 1494 |
| P28S, Y33H, S69P, N106I, A112V, S118Y | 1447 | 1471 | 1495 |
| Y33H, P42L, N47K, V101M, A112V | 1448 | 1472 | 1496 |
| Y33H, N47K, F74S, Q83K, N106I, F111L, A112V, S118T | 1449 | 1473 | 1497 |
| Y33H, A112V, S118T, V119A | 1450 | 1474 | 1498 |
| Y33H, N106I, A112V, S118F | 1451 | 1475 | 1499 |
| Y33H, K66M, S118F, W124L | 1452 | 1476 | 1500 |
| N106I, A112V | 1453 | 1477 | 1501 |

TABLE 4

| Exemplary variant CD155 polypeptides | | | |
|---|---|---|---|
| Mutation(s) | ECD SEQ ID NO | IgV SEQ ID NO | |
| Wild-type | 268 | 378 | 421 |
| P18S, P64S, F91S | 379 | 400 | 422 |
| P18S, F91S, L104P | 380 | 401 | 423 |
| L44P | 381 | 402 | 424 |
| A56V | 382 | 403 | 425 |
| P18L, L79V, F91S | 383 | 404 | 426 |
| P18S, F91S | 384 | 405 | 427 |
| P18T, F91S | 385 | 406 | 428 |
| P18T, S42P, F91S | 386 | 407 | 429 |
| G7E, P18T, Y30C, F91S | 387 | 408 | 430 |
| P18T, F91S, G111D | 388 | 409 | 431 |
| P18S, F91P | 389 | 410 | 432 |
| P18T, F91S, F108L | 390 | 411 | 433 |
| P18T, T45A, F91S | 391 | 412 | 434 |
| P18T, F91S, R94H | 392 | 413 | 435 |
| P18S, Y30C, F91S | 393 | 414 | 436 |
| A81V, L83P | 394 | 415 | 437 |
| L88P | 395 | 416 | 438 |

TABLE 4-continued

Exemplary variant CD155 polypeptides

| Mutation(s) | ECD SEQ ID NO | IgV SEQ ID NO | |
|---|---|---|---|
| R94H | 396 | 417 | 439 |
| A13E, P18S, A56V, F91S | 397 | 418 | 440 |
| P18T, F91S, V115A | 398 | 419 | 441 |
| P18T, Q60K | 399 | 420 | 442 |
| S52M | 443 | 540 | 637 |
| T45Q, S52L, L104E, G111R | 444 | 541 | 638 |
| S42G | 445 | 542 | 639 |
| Q62F | 446 | 543 | 640 |
| S52Q | 447 | 544 | 641 |
| S42A, L104Q, G111R | 448 | 545 | 642 |
| S42A, S52Q, L104Q, G111R | 449 | 546 | 643 |
| S52W, L104E | 450 | 547 | 644 |
| S42C | 451 | 548 | 645 |
| S52W | 452 | 549 | 646 |
| S52M, L104Q | 453 | 550 | 647 |
| S42L, S52L, Q62F, L104Q | 454 | 551 | 648 |
| S42W | 455 | 552 | 649 |
| S42Q | 456 | 553 | 650 |
| S52L | 457 | 554 | 651 |
| S52R | 458 | 555 | 652 |
| L104E | 459 | 556 | 653 |
| G111R | 460 | 557 | 654 |
| S52E | 461 | 558 | 655 |
| Q62Y | 462 | 559 | 656 |
| T45Q, S52M, L104E | 463 | 560 | 657 |
| S42N, L104Q, G111R | 464 | 561 | 658 |
| S52M, V57L | 465 | 562 | 659 |
| S42N, S52Q, Q62F | 466 | 563 | 660 |
| S42A, S52L, L104E, G111R | 467 | 564 | 661 |
| S42W, S52Q, V57L, Q62Y | 468 | 565 | 662 |
| L104Q | 469 | 566 | 663 |
| S42L, S52Q, L104E | 470 | 567 | 664 |
| S42C, S52L | 471 | 568 | 665 |
| S42W, S52R, Q62Y, L104Q | 472 | 569 | 666 |
| T45Q, S52R, L104E | 473 | 570 | 667 |
| S52R, Q62F, L104Q, G111R | 474 | 571 | 668 |
| T45Q, S52L, V57L, L104E | 475 | 572 | 669 |
| S52M, Q62Y | 476 | 573 | 670 |
| Q62F, L104E, G111R | 477 | 574 | 671 |
| T45Q, S52Q | 478 | 575 | 672 |
| S52L, L104E | 479 | 576 | 673 |
| S42V, S52E | 480 | 577 | 674 |
| T45Q, S52R, G111R | 481 | 578 | 675 |
| S42G, S52Q, L104E, G111R | 482 | 579 | 676 |
| S42N, S52E, V57L, L104E | 483 | 580 | 677 |
| S42C, S52M, Q62F | 484 | 581 | 678 |
| S42L | 485 | 582 | 679 |
| S42A | 486 | 583 | 680 |
| S42G, S52L, Q62F, L104Q | 487 | 584 | 681 |
| S42N | 488 | 585 | 682 |
| P18T, S65A, S67V, F91S | 489 | 586 | 683 |
| P18F, T39A, T45Q, T61R, S65N, S67L, E73G, R78G | 490 | 587 | 684 |
| P18T, T45Q, T61R, S65N, S67L | 491 | 588 | 685 |
| P18F, S65A, S67V, F91S | 492 | 589 | 686 |
| P18F, T45Q, T61R, S65N, S67L, F91S, L104P | 493 | 590 | 687 |
| P18S, L79P, L104M | 494 | 591 | 688 |
| P18S, L104M | 495 | 592 | 689 |
| L79P, L104M | 496 | 593 | 690 |
| P18T, T45Q, L79P | 497 | 594 | 691 |
| P18T, T45Q, T61R, S65H, S67H | 498 | 595 | 692 |
| P18T, A81E | 499 | 596 | 693 |
| P18S, D23Y, E37P, S52G, Q62M, G80S, A81P, G99Y, S112N | 500 | 597 | 694 |
| A13R, D23Y, E37P, S42P, Q62Y, A81E | 501 | 598 | 695 |
| A13R, D23Y, E37P, G99Y, S112N | 502 | 599 | 696 |
| A13R, D23Y, E37P, Q62M, A77V, G80S, A81P, G99Y | 503 | 600 | 697 |
| P18L, E37S, Q62M, G80S, A81P, G99Y, S112N | 504 | 601 | 698 |
| P18S, L104T | 505 | 602 | 699 |
| P18S, Q62H, L79Q, F91S | 506 | 603 | 700 |
| T45Q, S52K, Q62F, L104Q, G111R | 507 | 604 | 701 |
| T45Q, S52Q, Q62Y, L104Q, G111R | 508 | 605 | 702 |
| T45Q, S52Q, Q62Y, L104E, G111R | 509 | 606 | 703 |
| V57A, T61M, S65W, S67A, E96D, L104T | 510 | 607 | 704 |
| P18L, V57T, T61S, S65Y, S67A, L104T | 511 | 608 | 705 |
| P18T, T45Q | 512 | 609 | 706 |
| P18L, V57A, T61M, S65W, S67A, L104T | 513 | 610 | 707 |

TABLE 4-continued

Exemplary variant CD155 polypeptides

| Mutation(s) | ECD SEQ ID NO | IgV SEQ ID NO | |
|---|---|---|---|
| T61M, S65W, S67A, L104T | 514 | 611 | 708 |
| P18S, V41A, S42G, T45G, L104N | 515 | 612 | 709 |
| P18H, S42G, T45I, S52T, G53R, S54H, V57L, H59E, T61S, S65D, E68G, L104N | 516 | 613 | 710 |
| P18S, S42G, T45V, F58L, S67W, L104N | 517 | 614 | 711 |
| P18S, T45I, L104N | 518 | 615 | 712 |
| P18S, S42G, T45G, L104N, V106A | 519 | 616 | 713 |
| P18H, H40R, S42G, T45I, S52T, G53R, S54H, V57L, H59E, T61S, S65D, E68G, L104Y, V106L, F108H | 520 | 617 | 714 |
| E37V, S42G, T45G, L104N | 521 | 618 | 715 |
| P18S, T45Q, L79P, L104T | 522 | 619 | 716 |
| P18L, Q62R | 523 | 620 | 717 |
| A13R, D23Y, E37P, S42L, S52G, Q62Y, A81E | 524 | 621 | 718 |
| P18L, H49R, L104T, D116N | 525 | 622 | 719 |
| A13R, D23Y, E37P, Q62M, G80S, A81P, L104T | 526 | 623 | 720 |
| S65T, L104T | 527 | 624 | 721 |
| A13R, D23Y, E37P, S52G, V57A, Q62M, K70E, L104T | 528 | 625 | 722 |
| P18L, A47V, Q62Y, E73D, L104T | 529 | 626 | 723 |
| H40T, V41M, A47V, S52Q, Q62L, S65T, E73R, D97G, E98S, L104T, D116N | 530 | 627 | 724 |
| P18L, S42P, T45Q, T61G, S65H, S67E, L104T, D116N | 531 | 628 | 725 |
| P18S, H40T, V41M, A47V, S52Q, Q62L, S65T, E73R, L104M, V106A | 532 | 629 | 726 |
| H40T, V41M, A47V, S52Q, Q62L, S65T, E68G, E73R, D97G, E98S, L104T | 533 | 630 | 727 |
| T45Q, S52E, L104E | 534 | 631 | 728 |
| T45Q, S52E, Q62F, L104E | 535 | 632 | 729 |
| P18F, T26M, L44V, Q62K, L79P, F91S, L104M, G111D | 536 | 633 | 730 |
| P18S, T45S, T61K, S65W, S67A, F91S, G111R | 537 | 634 | 731 |
| P18S, L79P, L104M, T107M | 538 | 635 | 732 |
| P18S, S65W, S67A, M90V, V95A, L104Q, G111R | 539 | 636 | 733 |
| P18S, A47G, L79P, F91S, L104M, T107A, R113W | 1548 | 1502 | 1525 |
| P18T, D23G, S24A, N35D, H49L, L79P, F91S, L104M, G111R | 1549 | 1503 | 1526 |
| V9L, P18S, Q60R, V75L, L79P, R89K, F91S, L104E, G111R | 1550 | 1504 | 1527 |
| P18S, H49R, E73D, L79P, N85D, F91S, V95A, L104M, G111R | 1551 | 1505 | 1528 |
| V11A, P18S, L79P, F91S, L104M, G111R | 1552 | 1506 | 1529 |
| V11A, P18S, S54R, Q60P, Q62K, L79P, N85D, F91S, T107M | 1553 | 1507 | 1530 |
| P18T, S52P, S65A, S67V, L79P, F91S, L104M, G111R | 1554 | 1508 | 1531 |
| P18T, M36T, L79P, F91S, G111R | 1555 | 1509 | 1532 |
| D8G, P18S, M36I, V38A, H49Q, A76E, F91S, L104M, T107A, R113W | 1556 | 1510 | 1533 |
| P18S, S52P, S65A, S67V, L79P, F91S, L104M, T107S, R113W | 1557 | 1511 | 1534 |
| T15I, P18T, L79P, F91S, L104M, G111R | 1558 | 1512 | 1535 |
| P18F, T26M, L44V, Q62K, L79P, E82D, F91S, L104M, G111D | 1559 | 1513 | 1536 |
| P18T, E37G, G53R, Q62K, L79P, F91S, E98D, L104M, T107M | 1560 | 1514 | 1537 |
| P18L, K70E, L79P, F91S, V95A, G111R | 1561 | 1515 | 1538 |
| V9I, Q12K, P18F, S65A, S67V, L79P, L104T, G111R, S112I | 1562 | 1516 | 1539 |
| P18F, S65A, S67V, F91S, L104M, G111R | 1563 | 1517 | 1540 |
| V9I, V10I, P18S, F20S, T45A, L79P, F91S, L104M, F108Y, G111R, S112V | 1564 | 1518 | 1541 |
| V9L, P18L, L79P, M90I, F91S, T102S, L104M, G111R | 1565 | 1519 | 1542 |
| P18C, T26M, L44V, M55I, Q62K, L79P, F91S, L104M, T107M | 1566 | 1520 | 1543 |
| V9I, P18T, D23G, L79P, F91S, G111R | 1567 | 1521 | 1544 |
| P18F, L79P, M90L, F91S, V95A, L104M, G111R | 1568 | 1522 | 1545 |
| P18T, M36T, S65A, S67E, L79Q, A81T, F91S, G111R | 1569 | 1523 | 1546 |
| V9L, P18T, Q62R, L79P, F91S, L104M, G111R | 1570 | 1524 | 1547 |
| P18S, S65W, S67A, L104Q, G111R | 1571 | 1572 | 1573 |
| P18T, G19D, M36T, S54N, L79P, L83Q, F91S, T107M, F108Y | 1574 | 1620 | 1666 |
| V9L, P18L, M55V, S69L, L79P, A81E, F91S, T107M | 1575 | 1621 | 1667 |
| P18F, H40Q, T61K, Q62K, L79P, F91S, L104M, T107V | 1576 | 1622 | 1668 |
| P18S, Q32R, Q62K, R78G, L79P, F91S, T107A, R113W | 1577 | 1623 | 1669 |
| Q12H, P18T, L21S, G22S, V57A, Q62R, L79P, F91S, T107M | 1578 | 1624 | 1670 |
| V9I, P18S, S24P, H49Q, F58Y, Q60R, Q62K, L79P, F91S, T107M | 1579 | 1625 | 1671 |
| P18T, W46C, H49R, S65A, S67V, A76T, L79P, S87T, L104M | 1580 | 1626 | 1672 |
| P18S, S42T, E51G, L79P, F91S, G92W, T107M | 1581 | 1627 | 1673 |
| V10F, T15S, P18L, R48Q, L79P, F91S, T107M, V115M | 1582 | 1628 | 1674 |
| P18S, L21M, Y30F, N35D, R84W, F91S, T107M, D116G | 1583 | 1629 | 1675 |
| P18F, E51V, S54G, Q60R, L79Q, E82G, S87T, M90I, F91S, G92R, T107M | 1584 | 1630 | 1676 |
| Q16H, P18F, F91S, T107M | 1585 | 1631 | 1677 |
| P18T, D23G, Q60R, S67L, L79P, F91S, T107M, V115A | 1586 | 1632 | 1678 |
| D8G, V9I, V11A, P18T, T26M, S52P, L79P, F91S, G92A, T107L, V115A | 1587 | 1633 | 1679 |
| V9I, P18F, A47E, G50S, E68G, L79P, F91S, T107M | 1588 | 1634 | 1680 |
| P18S, M55I, Q62K, S69P, L79P, F91S, T107M | 1589 | 1635 | 1681 |
| P18T, T39S, S52P, S54R, L79P, F91S, T107M | 1590 | 1636 | 1682 |
| P18S, D23N, L79P, F91S, T107M, S114N | 1591 | 1637 | 1683 |
| P18S, P34S, E51V, L79P, F91S, G111R | 1592 | 1638 | 1684 |
| P18S, H59N, V75A, L79P, A81T, F91S, L104M, T107M | 1593 | 1639 | 1685 |
| P18S, W46R, E68D, L79P, F91S, T107M, R113G | 1594 | 1640 | 1686 |
| V9L, P18F, T45A, S65A, S67V, R78K, L79V, F91S, T107M, S114T | 1595 | 1641 | 1687 |
| P18T, M55L, T61R, L79P, F91S, V106I, T107M | 1596 | 1642 | 1688 |

TABLE 4-continued

Exemplary variant CD155 polypeptides

| Mutation(s) | ECD SEQ ID NO | IgV SEQ ID NO | |
|---|---|---|---|
| T15I, P18S, V33M, N35F, T39S, M55L, R78S, L79P, F91S, T107M | 1597 | 1643 | 1689 |
| P18S, Q62K, K70E, L79P, F91S, G92E, R113W | 1598 | 1644 | 1690 |
| P18F, F20I, T26M, A47V, E51K, L79P, F91S | 1599 | 1645 | 1691 |
| P18T, D23A, Q60H, L79P, M90V, F91S, T107M | 1600 | 1646 | 1692 |
| P18S, D23G, C29R, N35D, E37G, M55I, Q62K, S65A, S67G, R78G, L79P, F91S, L104M, T107M, Q110R | 1601 | 1647 | 1693 |
| A13E, P18S, M36R, Q62K, S67T, L79P, N85D, F91S, T107M | 1602 | 1648 | 1694 |
| V9I, P18T, H49R, L79P, N85D, F91S, L104T, T107M | 1603 | 1649 | 1695 |
| V9A, P18F, T61S, Q62L, L79P, F91S, G111R | 1604 | 1650 | 1696 |
| D8E, P18T, T61A, L79P, F91S, T107M | 1605 | 1651 | 1697 |
| P18S, V41A, H49R, S54C, L79S, N85Y, L88P, F91S, L104M, T107M | 1606 | 1652 | 1698 |
| V11E, P18H, F20Y, V25E, N35S, H49R, L79P, F91S, T107M, G111R | 1607 | 1653 | 1699 |
| V11A, P18F, D23A, L79P, G80D, V95A, T107M | 1608 | 1654 | 1700 |
| P18S, K70R, L79P, F91S, G111R | 1609 | 1655 | 1701 |
| V9L, V11M, P18S, N35S, S54G, Q62K, L79P, L104M, T107M, V115M | 1610 | 1656 | 1702 |
| V9L, P18Y, V25A, V38G, M55V, A77T, L79P, M90I, F91S, L104M | 1611 | 1657 | 1703 |
| V10G, P18T, L72Q, L79P, F91S, T107M | 1612 | 1658 | 1704 |
| P18S, H59R, A76G, R78S, L79P | 1613 | 1659 | 1705 |
| V9A, P18S, M36T, S65G, L79P, F91S, L104T, G111R, S112I | 1614 | 1660 | 1706 |
| P18T, S52A, V57A, Q60R, Q62K, S65C, L79P, F91T, N100Y, T107M | 1615 | 1661 | 1707 |
| V11A, P18F, N35D, A47E, Q62K, L79P, F91S, G99D, T107M, S114N | 1616 | 1662 | 1708 |
| V11A, P18T, N35S, L79P, S87T, F91S | 1617 | 1663 | 1709 |
| V9D, V11M, Q12L, P18S, E37V, M55I, Q60R, K70Q, L79P, F91S, L104M, T107M | 1618 | 1664 | 1710 |
| T15S, P18S, Y30H, Q32L, Q62R, L79P, F91S, T107M | 1619 | 1665 | 1711 |

TABLE 5

Exemplary variant PD-L1 polypeptides

| Mutation(s) | ECD SEQ ID NO | | IgV SEQ ID NO | |
|---|---|---|---|---|
| Wild-type | 251 | 1721 | 1000 | 1196 |
| K28N/M41V/N45T/H51N/K57E | 1001 | 1931 | 1066 | 1131 |
| I20L/I36T/N45D/I47T | 1002 | 1932 | 1067 | 1132 |
| I20L/M41K/K44E | 1003 | 1933 | 1068 | 1133 |
| P6S/N45T/N78I/I83T | 1004 | 1934 | 1069 | 1134 |
| N78I | 1005 | 1935 | 1070 | 1135 |
| M41K/N78I | 1006 | 1936 | 1071 | 1136 |
| N45T/N78I | 1007 | 1937 | 1072 | 1137 |
| I20L/N45T | 1008 | 1938 | 1073 | 1138 |
| N45T | 1009 | 1939 | 1074 | 1139 |
| M41K | 1010 | 1940 | 1075 | 1140 |
| I20L/I36T/N45D | 1011 | 1941 | 1076 | 1141 |
| N17D/N45T/V50A/D72G | 1012 | 1942 | 1077 | 1142 |
| I20L/F49S | 1013 | 1943 | 1078 | 1143 |
| N45T/V50A | 1014 | 1944 | 1079 | 1144 |
| I20L/N45T/N78I | 1015 | 1945 | 1080 | 1145 |
| I20L/N45T/V50A | 1016 | 1946 | 1081 | 1146 |
| M41V/N45T | 1017 | 1947 | 1082 | 1147 |
| M41K/N45T | 1018 | 1948 | 1083 | 1148 |
| A33D/S75P/D85E | 1019 | 1949 | 1084 | 1149 |
| M18I/M41K/D43G/H51R/N78I | 1020 | 1950 | 1085 | 1150 |
| V11E/I20L/I36T/N45D/H60R/S75P | 1021 | 1951 | 1086 | 1151 |
| A33D/V50A | 1022 | 1952 | 1087 | 1152 |
| S16G/A33D/K71E/S75P | 1023 | 1953 | 1088 | 1153 |
| E27G/N45T/M97I | 1024 | 1954 | 1089 | 1154 |
| E27G/N45T/K57R | 1025 | 1955 | 1090 | 1155 |
| A33D/E53V | 1026 | 1956 | 1091 | 1156 |
| D43G/N45D/V58A | 1027 | 1957 | 1092 | 1157 |
| E40G/D43V/N45T/V50A | 1028 | 1958 | 1093 | 1158 |
| Y14S/K28E/N45T | 1029 | 1959 | 1094 | 1159 |
| A33D/N78S | 1030 | 1960 | 1095 | 1160 |
| A33D/N78I | 1031 | 1961 | 1096 | 1161 |
| A33D/N45T | 1032 | 1962 | 1097 | 1162 |
| A33D/N45T/N78I | 1033 | 1963 | 1098 | 1163 |
| E27G/N45T/V50A | 1034 | 1964 | 1099 | 1164 |
| N45T/V50A/N78S | 1035 | 1965 | 1100 | 1165 |
| I20L/N45T/V110M | 1036 | 1966 | 1101 | 1166 |
| I20L/I36T/N45T/V50A | 1037 | 1967 | 1102 | 1167 |
| N45T/L74P/S75P | 1038 | 1968 | 1103 | 1168 |

TABLE 5-continued

| Exemplary variant PD-L1 polypeptides | | | | |
|---|---|---|---|---|
| Mutation(s) | ECD SEQ ID NO | | IgV SEQ ID NO | |
| N45T/S75P | 1039 | 1969 | 1104 | 1169 |
| S75P/K106R | 1040 | 1970 | 1105 | 1170 |
| S75P | 1041 | 1971 | 1106 | 1171 |
| A33D/S75P | 1042 | 1972 | 1107 | 1172 |
| A33D/S75P/D104G | 1043 | 1973 | 1108 | 1173 |
| A33D/S75P | 1044 | 1974 | 1109 | 1174 |
| I20L/E27G/N45T/V50A | 1045 | 1975 | 1110 | 1175 |
| I20L/E27G/D43G/N45D/V58A/N78I | 1046 | 1976 | 1111 | 1176 |
| I20L/D43G/N45D/V58A/N78I | 1047 | 1977 | 1112 | 1177 |
| I20L/A33D/D43G/N45D/V58A/N78I | 1048 | 1978 | 1113 | 1178 |
| I20L/D43G/N45D/N78I | 1049 | 1979 | 1114 | 1179 |
| E27G/N45T/V50A/N78I | 1050 | 1980 | 1115 | 1180 |
| N45T/V50A/N78I | 1051 | 1981 | 1116 | 1181 |
| V11A/I20L/E27G/D43G/N45D/H51Y/S99G | 1052 | 1982 | 1117 | 1182 |
| I20L/E27G/D43G/N45T/V50A | 1053 | 1983 | 1118 | 1183 |
| I20L/K28E/D43G/N45D/V58A/Q89R | 1054 | 1984 | 1119 | 1184 |
| I20L/I36T/N45D | 1055 | 1985 | 1120 | 1185 |
| I20L/K28E/D43G/N45D/E53G/V58A/N78I | 1056 | 1986 | 1121 | 1186 |
| A33D/D43G/N45D/V58A/S75P | 1057 | 1987 | 1122 | 1187 |
| K23R/D43G/N45D | 1058 | 1988 | 1123 | 1188 |
| I20L/D43G/N45D/V58A/N78I/D90G/G101D | 1059 | 1989 | 1124 | 1189 |
| D43G/N45D/L56Q/V58A/G101G-ins | 1060 | 1990 | 1125 | 1190 |
| I20L/K23E/D43G/N45D/V58A/N78I | 1061 | 1991 | 1126 | 1191 |
| I20L/K23E/D43G/N45D/V50A/N78I | 1062 | 1992 | 1127 | 1192 |
| T19I/E27G/N45I/V50A/N78I/M97K | 1063 | 1993 | 1128 | 1193 |
| I20L/M41K/D43G/N45D | 1064 | 1994 | 1129 | 1194 |
| K23R/N45T/N78I | 1065 | 1995 | 1130 | 1195 |
| I20L/K28E/D43G/N45D/V58A/Q89R/G101G-ins (G101GG) | 1718 | 1996 | 1719 | 1720 |
| K57R/S99G | 1722 | 1812 | 1901 | 1916 |
| K57R/S99G/F189L | 1723 | 1813 | | |
| M18V/M97L/F193S/R195G/E200K/H202Q | 1724 | 1814 | | |
| I36S/M41K/M97L/K144Q/R195G/E200K/H202Q/L206F | 1725 | 1815 | | |
| C22R/Q65L/L124S/K144Q/R195G/E200N/H202Q/T221L | 1726 | | | |
| M18V/I98L/L124S/P198T/L206F | 1727 | 1816 | | |
| S99G/N117S/I148V/K171R/R180S | 1728 | 1817 | | |
| I36T/M97L/A103V/Q155H | 1729 | 1818 | | |
| K28I/S99G | 1730 | 1819 | 1902 | 1917 |
| R195S | 1731 | 1820 | | |
| A79T/S99G/T185A/R195G/E200K/H202Q/L206F | 1732 | 1821 | | |
| K57R/S99G/L124S/K144Q | 1733 | 1822 | | |
| K57R/S99G/R195G | 1734 | 1823 | | |
| D55V/M97L/S99G | 1735 | 1824 | 1903 | 1918 |
| E27G/I36T/D55N/M97L/K111E | 1736 | 1825 | 1904 | 1919 |
| E54G/M97L/S99G | 1737 | 1826 | 1905 | 1920 |
| G15A/I36T/M97L/K111E/H202Q | 1738 | 1827 | | |
| G15A/I36T/V129D | 1739 | 1828 | | |
| G15A/I36T/V129D/R195G | 1740 | 1829 | | |
| G15A/V129D | 1741 | 1830 | | |
| I36S/M97L | 1742 | 1831 | 1906 | 1921 |
| I36T/D55N/M97L/K111E/A204T | 1743 | 1832 | | |
| I36T/D55N/M97L/K111E/V129A/F173L | 1744 | 1833 | | |
| I36T/D55S/M97L/K111E/I148V/R180S | 1745 | 1834 | | |
| I36T/G52R/M97L/V112A/K144E/V175A/P198T | 1746 | 1835 | | |
| I36T/I46V/D55G/M97L/K106E/K144E/T185A/R195G | 1747 | 1836 | | |
| I36T/I83T/M97L/K144E/P198T | 1748 | 1837 | | |
| I36T/M97L/K111E | 1749 | 1838 | 1907 | 1922 |
| I36T/M97L/K144E/P198T | 1750 | 1839 | | |
| I36T/M97L/Q155H/F193S/N201Y | 1751 | 1840 | | |
| I36T/M97L/V129D | 1752 | 1841 | | |
| L35P/I36S/M97L/K111E | 1753 | 1842 | 1908 | 1923 |
| M18I/I36T/E53G/M97L/K144E/E199G/V207A | 1754 | 1843 | | |
| M18T/I36T/D55N/M97L/K111E | 1755 | 1844 | 1909 | 1924 |
| M18V/M97L/T176N/R195G | 1756 | 1845 | | |
| M97L/S99G | 1757 | 1846 | 1910 | 1925 |
| N17D/M97L/S99G | 1758 | 1847 | 1911 | 1926 |
| S99G/T185A/R195G/P198T | 1759 | 1848 | | |
| V129D/H202Q | 1760 | 1849 | | |
| V129D/P198T | 1761 | 1850 | | |
| V129D/T150A | 1762 | 1851 | | |
| V93E/V129D | 1763 | 1852 | | |
| Y10F/M18V/S99G/Q138R/T203A | 1764 | 1853 | | |
| N45D | 1765 | 1854 | 1912 | 1927 |
| K160M/R195G | 1766 | 1855 | | |
| N45D/K144E | 1767 | 1856 | | |
| N45D/P198S | 1768 | 1857 | | |

TABLE 5-continued

| Exemplary variant PD-L1 polypeptides | | |
|---|---|---|
| Mutation(s) | ECD SEQ ID NO | IgV SEQ ID NO |
| N45D/P198T | 1769 1858 | |
| N45D/R195G | 1770 1859 | |
| N45D/R195S | 1771 1860 | |
| N45D/S131F | 1772 1861 | |
| N45D/V58D | 1773 1862 | 1913 1928 |
| V129D/R195S | 1774 1863 | |
| I98T/F173Y/L196S | 1775 1864 | |
| N45D/E134G/L213P | 1776 1865 | |
| N45D/F173I/S177C | 1777 1866 | |
| N45D/I148V/R195G | 1778 1867 | |
| N45D/K111T/R195G | 1779 1868 | |
| N45D/N113Y/R195S | 1780 1869 | |
| N45D/N165Y/E170G | 1781 1870 | |
| N45D/Q89R/I98V | 1782 1871 | 1914 1929 |
| N45D/S131F/P198S | 1783 1872 | |
| N45D/S75P/P198S | 1784 1873 | |
| N45D/V50A/R195T | 1785 1874 | |
| E27D/N45D/T183A/I188V | 1786 1875 | |
| F173Y/T183I/L196S/T203A | 1787 1876 | |
| K23N/N45D/S75P/N120S | 1788 1877 | |
| N45D/G102D/R194W/R195G | 1789 1878 | |
| N45D/G52V/Q121L/P198S | 1790 1879 | |
| N45D/I148V/R195G/N201D | 1791 1880 | |
| N45D/K111T/T183A/I188V | 1792 1881 | |
| N45D/Q89R/F189S/P198S | 1793 1882 | |
| N45D/S99G/C137R/V207A | 1794 1883 | |
| N45D/T163I/K167R/R195G | 1795 1884 | |
| N45D/T183A/T192S/R194G | 1796 1885 | |
| N45D/V50A/I119T/K144E | 1797 1886 | |
| T19A/N45D/K144E/R195G | 1798 1887 | |
| V11E/N45D/T130A/P198T | 1799 1888 | |
| V26A/N45D/T163I/T185A | 1800 1889 | |
| K23N/N45D/L124S/K167T/R195G | 1801 1890 | |
| K23N/N45D/Q73R/T163I | 1802 1891 | |
| K28E/N45D/W149R/S158G/P198T | 1803 1892 | |
| K28R/N45D/K57E/I98V/R195S | 1804 1893 | |
| K28R/N45D/V129D/T163N/R195T | 1805 1894 | |
| M41K/D43G/N45D/R64S/R195G | 1806 1895 | |
| M41K/D43G/N45D/R64S/S99G | 1807 1896 | 1915 1930 |
| N45D/R68L/F173L/D197G/P198S | 1808 1897 | |
| N45D/V50A/I148V/R195G/N201D | 1809 1898 | |
| M41K/D43G/K44E/N45D/R195G/N201D | 1810 1899 | |
| N45D/V50A/L124S/K144E/L179P/R195G | 1811 1900 | |

TABLE 6

| Exemplary variant PD-L2 polypeptides | | |
|---|---|---|
| Mutation(s) | ECD SEQ ID NO | IgV SEQ ID NO |
| Wild-type | 252 | 1197 1257 |
| H15Q | 1198 | 1275 1351 |
| N24D | 1199 | 1276 1352 |
| E44D | 1200 | 1277 1353 |
| V89D | 1201 | 1278 1354 |
| Q82R/V89D | 1202 | 1279 1355 |
| E59G/Q82R | 1203 | 1280 1356 |
| S39I/V89D | 1204 | 1281 1357 |
| S67L/V89D | 1205 | 1282 1358 |
| S67L/I85F | 1206 | 1283 1359 |
| S67L/I86T | 1207 | 1284 1360 |
| H15Q/K65R | 1208 | 1285 1361 |
| H15Q/Q72H/V89D | 1209 | 1286 1362 |
| H15Q/S67L/R76G | 1210 | 1287 1363 |
| H15Q/R76G/I85F | 1211 | 1288 1364 |
| H15Q/T47A/Q82R | 1212 | 1289 1365 |
| H15Q/Q82R/V89D | 1213 | 1290 1366 |
| H15Q/C23S/I86T | 1214 | 1291 1367 |
| H15Q/S39I/I86T | 1215 | 1292 1368 |
| H15Q/R76G/I85F | 1216 | 1293 1369 |
| E44D/V89D/W91R | 1217 | 1294 1370 |

TABLE 6-continued

| Exemplary variant PD-L2 polypeptides | | |
|---|---|---|
| Mutation(s) | ECD SEQ ID NO | IgV SEQ ID NO |
| I13V/S67L/V89D | 1218 | 1295 1371 |
| H15Q/S67L/I86T | 1219 | 1296 1372 |
| I13V/H15Q/S67L/I86T | 1220 | 1297 1373 |
| I13V/H15Q/E44D/V89D | 1221 | 1298 1374 |
| I13V/S39I/E44D/Q82R/V89D | 1222 | 1299 1375 |
| I13V/E44D/Q82R/V89D | 1223 | 1300 1376 |
| I13V/Q72H/R76G/I86T | 1224 | 1301 1377 |
| I13V/H15Q/R76G/I85F | 1225 | 1302 1378 |
| H15Q/S39I/R76G/V89D | 1226 | 1303 1379 |
| H15Q/S67L/R76G/I85F | 1227 | 1304 1380 |
| H15Q/T47A/Q72H/R76G/I86T | 1228 | 1305 1381 |
| H15Q/T47A/Q72H/R76G | 1229 | 1306 1382 |
| I13V/H15Q/T47A/Q72H/R76G | 1230 | 1307 1383 |
| H15Q/E44D/R76G/I85F | 1231 | 1308 1384 |
| H15Q/S39I/S67L/V89D | 1232 | 1309 1385 |
| H15Q/N32D/S67L/V89D | 1233 | 1310 1386 |
| N32D/S67L/V89D | 1234 | 1311 1387 |
| H15Q/S67L/Q72H/R76G/V89D | 1235 | 1312 1388 |
| H15Q/Q72H/Q74R/R76G/I86T | 1236 | 1313 1389 |
| G28V/Q72H/R76G/I86T | 1237 | 1314 1390 |
| I13V/H15Q/S39I/E44D/S67L | 1238 | 1315 1391 |

TABLE 6-continued

| Exemplary variant PD-L2 polypeptides | | |
|---|---|---|
| Mutation(s) | ECD SEQ ID NO | IgV SEQ ID NO |
| E44D/S67L/Q72H/Q82R/V89D | 1239 | 1316 1392 |
| H15Q/V89D | 1240 | 1317 1393 |
| H15Q/T47A | 1241 | 1318 1394 |
| I13V/H15Q/Q82R | 1242 | 1319 1395 |
| I13V/H15Q/V89D | 1243 | 1320 1396 |
| I13V/S67L/Q82R/V89D | 1244 | 1321 1397 |
| I13V/H15Q/Q82R/V89D | 1245 | 1322 1398 |
| H15Q/V31M/S67L/Q82R/V89D | 1246 | 1323 1399 |
| I13V/H15Q/T47A/Q82R | 1247 | 1324 1400 |
| I13V/H15Q/V31A/N45S/Q82R/V89D | 1248 | 1325 1401 |
| H15Q/T47A/H69L/Q82R/V89D | 1250 | 1327 1403 |
| I13V/H15Q/T47A/H69L/R76G/V89D | 1251 | 1328 1404 |
| I12V/I13V/H15Q/T47A/Q82R/V89D | 1252 | 1329 1405 |
| I13V/H15Q/R76G/D77N/Q82R/V89D | 1253 | 1330 1406 |
| I13V/H15Q/T47A/R76G/V89D | 1254 | 1331 1407 |
| I13V/H15Q/T47A/Q82R/V89D | 1255 | 1332 1408 |
| I13V/H15Q/N24D/Q82R/V89D | 1256 | 1333 1409 |
| I13V/H15Q/I36V/T47A/S67L/V89D | 1258 | 1334 1410 |
| H15Q/T47A/K65R/S67L/Q82R/V89D | 1259 | 1335 1411 |
| H15Q/L33P/T47A/S67L/P71S/V89D | 1260 | 1336 1412 |
| I13V/H15Q/Q72H/R76G/I86T | 1261 | 1337 1413 |
| H15Q/T47A/S67L/Q82R/V89D | 1262 | 1338 1414 |
| F2L/H15Q/D46E/T47A/Q72H/R76G/Q82R/V89D | 1263 | 1339 1415 |
| I13V/H15Q/L33F/T47A/Q82R/V89D | 1264 | 1340 1416 |
| I13V/H15Q/T47A/E58G/S67L/Q82R/V89D | 1265 | 1341 1417 |
| H15Q/N24S/T47A/Q72H/R76G/V89D | 1266 | 1342 1418 |
| I13V/H15Q/E44V/T47A/Q82R/V89D | 1267 | 1343 1419 |
| H15Q/N18D/T47A/Q72H/V73A/R76G/I86T/V89D | 1268 | 1344 1420 |
| I13V/H15Q/T37A/E44D/S48C/S67L/Q82R/V89D | 1269 | 1345 1421 |
| H15Q/L33H/S67L/R76G/Q82R/V89D | 1270 | 1346 1422 |
| I13V/H15Q/T47A/Q72H/R76G/I86T | 1271 | 1347 1423 |
| H15Q/S39I/E44D/Q72H/V75G/R76G/Q82R/V89D | 1272 | 1348 1424 |
| H15Q/T47A/S67L/R76G/Q82R/V89D | 1273 | 1349 1425 |
| I13V/H15Q/T47A/S67L/Q72H/R76G/Q82R/V89D | 1274 | 1350 1426 |

TABLE 7

| Exemplary variant NKp30 polypeptides | | |
|---|---|---|
| Mutation(s) | ECD SEQ ID NO | IgC SEQ ID NO |
| Wild-type | 275 | 343 |
| L30V/A60V/S64P/S86G | 334 | 344 |
| L30V | 335 | 345 |
| A60V | 336 | 346 |
| S64P | 337 | 347 |
| S86G | 338 | 348 |

TABLE 8

| Exemplary variant CD86 polypeptides | | |
|---|---|---|
| Mutation(s) | ECD SEQ ID NO | IgV SEQ ID NO |
| Wild-type | 250 | 349 |
| Q35H/H90L/Q102H | 339 | 350 |
| Q35H | 340 | 351 |
| H90L | 341 | 352 |
| Q102H | 342 | 353 |

In some embodiments, the two or more IgSF domain, including a vIgD of CD80 and one or more additional IgSF domain (e.g., second or third variant IgSF domain) from another IgSF family member, are covalently or non-covalently linked. A plurality of non-affinity modified and/or affinity modified IgSF domains in a stacked immunomodulatory protein polypeptide chain need not be covalently linked directly to one another. In some embodiments, the two or more IgSF domains are linked directly or indirectly, such as via a linker. In some embodiments, an intervening span of one or more amino acid residues indirectly covalently bonds IgSF domains to each other. The linkage can be via the N-terminal to C-terminal residues. In some embodiments, the linkage can be made via side chains of amino acid residues that are not located at the N-terminus or C-terminus of the IgSF domain(s). Thus, linkages can be made via terminal or internal amino acid residues or combinations thereof.

In some embodiments, the immunomodulatory protein contains at least two IgSF domains, each linked directly or indirectly via a linker. In some embodiments, the immunomodulatory protein contains at least three immunomodulatory proteins, each linked directly or indirectly via a linker. Various configurations are shown in FIGS. 5A and 5B.

In some embodiments, one or more "peptide linkers" link the vIgD of CD80 and one or more additional IgSF domain (e.g., second or third variant IgSF domain). In some embodiments, a peptide linker can be a single amino acid residue or greater in length. In some embodiments, the peptide linker has at least one amino acid residue but is no more than 20, 19, 18, 17, 16, 15, 14, 13, 12, 11, 10, 9, 8, 7, 6, 5, 4, 3, 2, or 1 amino acid residues in length. In some embodiments, the linker is a flexible linker. In some embodiments, the linker is (in one-letter amino acid code): GGGGS ("4GS") or multimers of the 4GS linker, such as repeats of 2, 3, 4, or 5 4GS linkers. In some embodiments, the peptide linker is $(GGGGS)_2$ (SEQ ID NO: 330) or $(GGGGS)_3$(SEQ ID NO: 329). In some embodiments, the linker also can include a series of alanine residues alone or in addition to another peptide linker (such as a 4GS linker or multimer thereof). In some embodiments, the number of alanine residues in each series is: 2, 3, 4, 5, or 6 alanines. In some embodiments, the linker also can include a series of alanine residues alone or in addition to another peptide linker (such as a 4GS linker or multimer thereof). In some embodiments, the number of alanine residues in each series is: 2, 3, 4, 5, or 6 alanines. In some embodiments, the linker is a rigid linker. For example, the linker is an α-helical linker. In some embodiments, the linker is (in one-letter amino acid code): EAAAK or multimers of the EAAAK linker, such as repeats of 2, 3, 4, or 5 EAAAK linkers, such as set forth in SEQ ID NO: 3026 (TxEAAAK), SEQ ID NO: 3027 (3×EAAAK) or SEQ ID NO: 3036 (5×EAAAK). In some embodiments, the linker can further include amino acids introduced by cloning and/or from a restriction site, for example the linker can include the amino acids GS (in one-letter amino acid code) as introduced by use of the restriction site BAMHI. In some examples, the linker is a 2×GGGGS followed by three alanines (GGGGSGGGGSAAA; SEQ ID NO: 331).

In some embodiments, the non-affinity modified and/or affinity modified IgSF domains are linked by "wild-type peptide linkers" inserted at the N-terminus and/or C-terminus of a non-affinity modified and/or affinity modified IgSF domains. These linkers are also called leading sequences (N-terminal to non-affinity modified or affinity modified IgSF domain) or trailing sequences (C-terminal to non-affinity modified or affinity modified IgSF domain), and sequences that exist in the wild-type protein that span immediately outside the structural prediction of the Ig fold of the IgSF. In some embodiments, the "wild-type linker" is an amino acid sequence that exists after the signal sequence, but before in the IgSF domain, such as the defined IgV domain, in the amino acid sequence of the wild-type protein. In some embodiments, the "wild-type" linker is an amino acid sequence that exists immediately after the IgSF domain, such as immediately after the defined IgV domain but before the IgC domain, in the amino acid sequence of the wild-type protein. These linker sequences can contribute to the proper folding and function of the neighboring IgSF domain(s). In some embodiments, there is present a leading peptide linker inserted at the N-terminus of the first IgSF domain and/or a trailing sequence inserted at the C-terminus of the first non-affinity modified and/or affinity modified IgSF domain. In some embodiments, there is present a second leading peptide linker inserted at the N-terminus of the second IgSF domain and/or a second trailing sequence inserted at the C-terminus of the second non-affinity modified and/or affinity modified IgSF domain. When the first and second non-affinity modified and/or affinity modified IgSF domains are derived from the same parental protein and are connected in the same orientation, wild-type peptide linkers between the first and second non-affinity modified and/or affinity modified IgSF domains are not duplicated. For example, when the first trailing wild-type peptide linker and the second leading wild-type peptide linker are the same, the Type II immunomodulatory protein does not comprise either the first trailing wild-type peptide linker or the second leading wild-type peptide linker.

In some embodiments, the Type II immunomodulatory protein comprises a first leading wild-type peptide linker inserted at the N-terminus of the first non-affinity modified and/or affinity modified IgSF domain, wherein the first leading wild-type peptide linker comprises at least 5 (such as at least about any of 6, 7, 8, 9, 10, 11, 12, 13, 14, 15, or more) consecutive amino acids from the intervening sequence in the wild-type protein from which the first non-affinity modified and/or affinity modified IgSF domain is derived between the parental IgSF domain and the immediately preceding domain (such as a signal peptide or an IgSF domain). In some embodiments, the first leading wild-type peptide linker comprises the entire intervening sequence in the wild-type protein from which the first non-affinity modified and/or affinity modified IgSF domain is derived between the parental IgSF domain and the immediately preceding domain (such as a signal peptide or an IgSF domain).

In some embodiments, the Type II immunomodulatory protein further comprises a first trailing wild-type peptide linker inserted at the C-terminus of the first non-affinity modified and/or affinity modified IgSF domain, wherein the first trailing wild-type peptide linker comprises at least 5 (such as at least about any of 6, 7, 8, 9, 10, 11, 12, 13, 14, 15, or more) consecutive amino acids from the intervening sequence in the wild-type protein from which the first non-affinity modified and/or affinity modified IgSF domain is derived between the parental IgSF domain and the immediately following domain (such as an IgSF domain or a transmembrane domain). In some embodiments, the first trailing wild-type peptide linker comprises the entire intervening sequence in the wild-type protein from which the first non-affinity modified and/or affinity modified IgSF domain is derived between the parental IgSF domain and the immediately following domain (such as an IgSF domain or a transmembrane domain).

In some embodiments, the Type II immunomodulatory protein further comprises a second leading wild-type peptide linker inserted at the N-terminus of the second non-affinity modified and/or affinity modified IgSF domain, wherein the second leading wild-type peptide linker comprises at least 5 (such as at least about any of 6, 7, 8, 9, 10, 11, 12, 13, 14, 15, or more) consecutive amino acids from the intervening sequence in the wild-type protein from which the second non-affinity modified and/or affinity modified IgSF domain is derived between the parental IgSF domain and the immediately preceding domain (such as a signal peptide or an IgSF domain). In some embodiments, the second leading wild-type peptide linker comprises the entire intervening sequence in the wild-type protein from which the second non-affinity modified and/or affinity modified IgSF domain is derived between the parental IgSF domain and the immediately preceding domain (such as a signal peptide or an IgSF domain).

In some embodiments, the Type II immunomodulatory protein further comprises a second trailing wild-type peptide linker inserted at the C-terminus of the second non-affinity modified and/or affinity modified IgSF domain, wherein the second trailing wild-type peptide linker comprises at least 5 (such as at least about any of 6, 7, 8, 9, 10, 11, 12, 13, 14, 15, or more) consecutive amino acids from the intervening sequence in the wild-type protein from which the second non-affinity modified and/or affinity modified IgSF domain is derived between the parental IgSF domain and the immediately following domain (such as an IgSF domain or a transmembrane domain). In some embodiments, the second trailing wild-type peptide linker comprises the entire intervening sequence in the wild-type protein from which the second non-affinity modified and/or affinity modified IgSF domain is derived between the parental IgSF domain and the immediately following domain (such as an IgSF domain or a transmembrane domain).

In some embodiments, the two or more IgSF domain, including a vIgD of CD80 and one or more additional IgSF domain (e.g., second and/or third variant IgSF domain) from another IgSF family member, are linked or attached to an Fc to form an Fc fusion, which, upon expression in a cell can, in some aspects, produce a dimeric multi-domain stack immunomodulatory protein. Thus, also provided are dimeric multi-domain immunomodulatory proteins.

In some embodiments, the variant CD80 polypeptide and one or more IgSF domain are independently linked, directly or indirectly, to the N- or C-terminus of an Fc region. In some embodiments, the variant CD80 polypeptide and at least one of the one or more additional IgSF domain are linked, directly or indirectly, and one of the variant CD80 and one of the one or more additional IgSF domain is also linked, directly or indirectly, to the N- or C-terminus of an Fc region. In some embodiments, the N- or C-terminus of the Fc region is linked to the variant CD80 polypeptide or the one or more additional IgSF domain and the other of the N- or C-terminus of the Fc region is linked to the other of the CD80 variant or another of the one or more additional IgSF domain. In some embodiments, linkage to the Fe is via a peptide linker, e.g., a peptide linker, such as described above. In some embodiments, linkage between the variant CD80 and the one or more additional IgSF domain is via a peptide linker, e.g., a peptide linker, such as described above. In some embodiments, the vIgD of CD80, the one or more additional IgSF domains, and the Fc domain can be linked together in any of numerous configurations as depicted in FIGS. 5A and 5B. Exemplary configurations are described in the Examples.

In some embodiments, the stacked immunomodulatory protein is a dimer formed by two immunomodulatory Fc fusion polypeptides. Also provided are nucleic acid molecules encoding any of the stacked immunomodulatory proteins. In some embodiments, the dimeric multi-domain stack immunomodulatory protein can be produced in cells by expression, or in some cases co-expression, of stack immunomodulatory Fc fusion polypeptides, such as described above in accord with generating dimeric Fc fusion proteins.

In some embodiments, the dimeric multi-domain stack immunomodulatory protein is divalent for each Fc region, monovalent for each subunit, or divalent for one subunit and tetravalent for the other.

In some embodiments, the dimeric multi-domain stack immunomodulatory protein is a homodimeric multi-domain stack Fc protein. In some embodiments, the dimeric multi-domain stack immunomodulatory protein comprises a first stack immunomodulatory Fc fusion polypeptide and a second stack immunomodulatory Fc fusion polypeptide in which the first and second polypeptide are the same. In some embodiments, the multi-domain stack molecule contains a first Fc fusion polypeptide containing a variant CD80 and a second IgSF domain and a second Fc fusion polypeptide containing the variant CD80 and the second IgSF domain. In some embodiments, the multi-domain stack molecule contains a first Fc fusion polypeptide containing a variant CD80, a second IgSF domain, and a third IgSF domain and a second Fc fusion polypeptide containing the variant CD80, the second IgSF domain, and the third IgSF domain. In some embodiments, the Fc portion of the first and/or second fusion polypeptide can be any Fc as described above. In some embodiments, the Fc portion or region of the first and second fusion polypeptide is the same.

In some embodiments, the multi-domain stack molecule is heterodimeric, comprising two different Fc fusion polypeptides, e.g., a first and a second Fc fusion polypeptide, wherein at least one is an Fc fusion polypeptide containing at least one variant CD80 polypeptide and/or at least one is an Fc fusion polypeptide containing a second IgSF domain (e.g., second variant IgSF domain). In some embodiments, the first or second Fc fusion polypeptide further contains a third IgSF domain (e.g., third variant IgSF domain). In some embodiments, the multi-domain stack molecule contains a first Fc fusion polypeptide containing a variant CD80 and a second Fc fusion polypeptide containing at a second IgSF domain, in which, in some cases, the first or second Fc fusion polypeptide additionally contains a third IgSF domain. In some embodiments, the multi-domain stack molecule contains a first Fc fusion polypeptide containing a variant CD80, a second IgSF domain, and in some cases, a third IgSF domain and a second Fc fusion polypeptide that is not linked to either a variant CD80 polypeptide or an additional IgSF domain. In some embodiments, the Fc portion or region of the first and second fusion polypeptide is the same. In some embodiments, the Fc portion or region of the first and second fusion polypeptide is different.

In some embodiments, the multi-domain stack molecule contains a first Fc fusion polypeptide containing 1, 2, 3, 4 or more variant CD80 polypeptides and 1, 2, 3, 4 or more additional IgSF domains, wherein the total number of IgSF domains in the first stack Fc fusion polypeptide is greater than 2, 3, 4, 5, 6 or more. In one example of such an embodiment, the second stack Fc fusion polypeptide contains 1, 2, 3, 4 or more variant CD80 polypeptides and 1, 2, 3, 4 or more additional IgSF domains, wherein the total number of IgSF domains in the first stack Fc fusion polypeptide is greater than 2, 3, 4, 5, 6 or more. In another example of such an embodiment, the second Fc fusion polypeptide is not linked to either a variant CD80 polypeptide or additional IgSF domain.

In some embodiments, the heterodimeric stack molecule contains a first stack immunomodulatory Fc fusion polypeptide and a second stack immunomodulatory Fc fusion polypeptide in which the first and second polypeptide are different. In some embodiments, a heterodimeric stack molecule contains a first Fc polypeptide fusion containing an Fc region and a first variant CD80 polypeptide and/or second IgSF domain (e.g., second variant IgSF domain) and a second Fc polypeptide fusion containing an Fc region and the other of the first variant CD80 polypeptide or the second IgSF domain. In some embodiments, a heterodimeric stack molecule contains a first Fc polypeptide fusion containing an Fc region and a first variant CD80 polypeptide and/or second IgSF domain (e.g., second variant IgSF domain) and a second Fc polypeptide fusion containing an Fc region and both the first variant CD80 polypeptide and second IgSF domain (e.g., second variant IgSF domain) but in a different orientation or configuration from the first Fc region. In some embodiments, the first and/or second Fc fusion polypeptide also contains a third IgSF domain (e.g., third variant IgSF domain).

In some embodiments, the Fc domain of one or both of the first and second stacked immunomodulatory Fc fusion polypeptide comprises a modification (e.g., substitution) such that the interface of the Fc molecule is modified to facilitate and/or promote heterodimerization. In some embodiments, modifications include introduction of a protuberance (knob) into a first Fc polypeptide and a cavity (hole) into a second Fc polypeptide such that the protuberance is positionable in the cavity to promote complexing of the first and second Fc-containing polypeptides. Amino acids targeted for replacement and/or modification to create protuberances or cavities in a polypeptide are typically interface amino acids that interact or contact with one or more amino acids in the interface of a second polypeptide.

In some embodiments, a sequence of amino acids is added preceding the Fc sequence for constructs in which the Fc sequence is the N-terminal portion of the sequence. In some cases, the sequence of amino acids HMSSVSAQ (SEQ ID NO:377) is added immediately preceding the Fc sequence for constructs in which the Fc sequence is the N-terminal portion of the sequence. In some embodiments, a heterodimeric stack molecule contains a first Fc polypeptide fusion containing an Fc region (knob; e.g., the Fc sequence set forth in SEQ ID NO: 374) and a first variant polypeptide and/or second IgSF domain (e.g., second variant IgSF domain) and a second Fc polypeptide fusion containing an Fc region (hole; e.g., the Fc sequence set forth in SEQ ID NO: 375) and a stuffer sequence HMSSVSAQ (SEQ ID NO:377) is added immediately preceding both Fc regions of the first and second Fc polypeptide fusion.

In some embodiments, a first polypeptide that is modified to contain protuberance (hole) amino acids include replacement of a native or original amino acid with an amino acid that has at least one side chain which projects from the interface of the first polypeptide and is therefore positionable in a compensatory cavity (hole) in an adjacent interface of a second polypeptide. Most often, the replacement amino acid is one which has a larger side chain volume than the original amino acid residue. One of skill in the art knows how to determine and/or assess the properties of amino acid residues to identify those that are ideal replacement amino acids to create a protuberance. In some embodiments, the replacement residues for the formation of a protuberance are naturally occurring amino acid residues and include, for example, arginine (R), phenylalanine (F), tyrosine (Y), or tryptophan (W). In some examples, the original residue identified for replacement is an amino acid residue that has a small side chain such as, for example, alanine, asparagine, aspartic acid, glycine, serine, threonine, or valine.

In some embodiments, a second polypeptide that is modified to contain a cavity (hole) is one that includes replacement of a native or original amino acid with an amino acid that has at least one side chain that is recessed from the interface of the second polypeptide and thus is able to accommodate a corresponding protuberance from the interface of a first polypeptide. Most often, the replacement amino acid is one which has a smaller side chain volume than the original amino acid residue. One of skill in the art knows how to determine and/or assess the properties of amino acid residues to identify those that are ideal replacement residues for the formation of a cavity. Generally, the replacement residues for the formation of a cavity are naturally occurring amino acids and include, for example, alanine (A), serine (S), threonine (T) and valine (V). In some examples, the original amino acid identified for replacement is an amino acid that has a large side chain such as, for example, tyrosine, arginine, phenylalanine, or tryptophan.

The CH3 interface of human IgG1, for example, involves sixteen residues on each domain located on four anti-parallel β-strands which buries 1090 A2 from each surface (see e.g., Deisenhofer et al. (1981) Biochemistry, 20:2361-2370; Miller et al., (1990) J Mol. Biol., 216, 965-973; Ridgway et al., (1996) Prot. Engin., 9: 617-621; U.S. Pat. No. 5,731,168). Modifications of a CH3 domain to create protuberances or cavities are described, for example, in U.S. Pat. No. 5,731,168; International Patent Applications WO98/50431 and WO 2005/063816; and Ridgway et al., (1996) Prot. Engin., 9: 617-621. In some examples, modifications of a CH3 domain to create protuberances or cavities are typically targeted to residues located on the two central anti-parallel β-strands. The aim is to minimize the risk that the protuberances which are created can be accommodated by protruding into the surrounding solvent rather than being accommodated by a compensatory cavity in the partner CH3 domain.

In some embodiments, the heterodimeric molecule contains a T366W mutation in the CH3 domain of the "knobs chain" and T366S, L368A, Y407V mutations in the CH3 domain of the "hole chain". In some cases, an additional interchain disulfide bridge between the CH3 domains can also be used (Merchant, A. M., et al., Nature Biotech. 16 (1998) 677-681) e.g., by introducing a Y349C mutation into the CH3 domain of the "knobs" or "hole" chain and a E356C mutation or a S354C mutation into the CH3 domain of the other chain. In some embodiments, the heterodimeric molecule contains S354C, T366W mutations in one of the two CH3 domains and Y349C, T366S, L368A, Y407V mutations in the other of the two CH3 domains. In some embodiments, the heterodimeric molecule comprises E356C, T366W mutations in one of the two CH3 domains and Y349C, T366S, L368A, Y407V mutations in the other of the two CH3 domains. In some embodiments, the heterodimeric molecule comprises Y349C, T366W mutations in one of the two CH3 domains and E356C, T366S, L368A, Y407V mutations in the other of the two CH3 domains. In some embodiments, the heterodimeric molecule comprises Y349C, T366W mutations in one of the two CH3 domains and S354C, T366S, L368A, Y407V mutations in the other of the two CH3 domains. Examples of other knobs-in-holes technologies are known in the art, e.g., as described by EP 1 870 459 A1.

In some embodiments, the Fc regions of the heterodimeric molecule additionally can contain one or more other Fc mutation, such as any described above. In some embodiments, the heterodimer molecule contains an Fc region with a mutation that reduces effector function.

In some embodiments, an Fc variant containing CH3 protuberance (knob) or cavity (hole) modifications can be joined to a stacked immunomodulatory polypeptide anywhere, but typically via its N- or C-terminus, to the N- or C-terminus of a first and/or second stacked immunomodulatory polypeptide, such as to form a fusion polypeptide. The linkage can be direct or indirect via a linker. Typically, a knob and hole molecule is generated by co-expression of a first stacked immunomodulatory polypeptide linked to an Fc variant containing CH3 protuberance modification(s) with a second stacked immunomodulatory polypeptide linked to an Fc variant containing CH3 cavity modification(s).

There is provided herein a homodimeric multi-domain stack molecule produced from a stack immunomodulatory Fc fusion polypeptide containing an IgSF domain, e.g., IgV domain, of a variant CD80 polypeptide and a second IgSF domain, e.g., IgV, of a variant CD155 polypeptide. In some embodiments, the resulting multi-domain stack molecules bind to both CTLA-4 and TIGIT. In some aspects, the binding to TIGIT is to the same or similar degree or, in some cases, is increased, compared to the binding to TIGIT of the corresponding IgSF domain of unmodified or wild-type CD155. In some aspects, the binding to CTLA-4 is to the same or similar degree, or, in some cases, is increased, compared to the binding to CTLA-4 of the corresponding IgSF domain of unmodified or wild-type CD80. In some embodiments, the binding to TIGIT or CTLA-4 is at least 30%, 40%, 50%, 60%, 70%, 80%, 90%, or more of the binding to TIGIT or CTLA-4 of the non-stacked form of the variant CD80 IgSF-Fc. In some embodiments, the binding to TIGIT is at least 30%, 40%, 50%, 60%, 70%, 80%, 90% or more of the binding to TIGIT of the non-stacked form of the variant CD155 IgSF-Fc. In some embodiments, the resulting multi-domain stack molecule increases T cell immune responses compared to the non-stack variant CD80 IgSF-Fc and/or variant CD155-IgSF-Fc, such as determined in a reporter assay. In some embodiments, the increase is greater than 1.2-fold, 1.3-fold, 1.4-fold, 1.5-fold, 2.0-fold, 3.0-fold, 4.0-fold, 5.0-fold or more.

There is provided herein a homodimeric multi-domain stack molecule produced from a stack immunomodulatory Fc fusion polypeptide containing an IgSF domain, e.g., IgV domain, of a variant CD80 polypeptide and a second IgSF domain, e.g., IgV, of a variant CD112 polypeptide. In some embodiments, the resulting multi-domain stack molecules bind to both CTLA-4 and CD112R. In some aspects, the binding to CD112R is to the same or similar degree or, in some cases, is increased, compared to the binding to CD112R of the corresponding IgSF domain of unmodified or wild-type CD112. In some aspects, the binding to CTLA-4 is to the same or similar degree, or, in some cases, is increased, compared to the binding to CTLA-4 of the corresponding IgSF domain of unmodified or wild-type CD80. In some embodiments, the binding to CD112R or CTLA-4 is at least 30%, 40%, 50%, 60%, 70%, 80%, 90%, or more of the binding to CD112R or CTLA-4 of the non-stacked form of the variant CD80 IgSF-Fc. In some embodiments, the binding to CD112R is at least 30%, 40%, 50%, 60%, 70%, 80%, 90% or more of the binding to CD112R of the non-stacked form of the variant CD112 IgSF-Fc. In some embodiments, the resulting multi-domain stack molecule increases T cell immune responses compared to the non-stack variant CD80 IgSF-Fc and/or variant CD112-IgSF-Fc, such as determined in a reporter assay. In some embodiments, the increase is greater than 1.2-fold, 1.3-fold, 1.4-fold, 1.5-fold, 2.0-fold, 3.0-fold, 4.0-fold, 5.0-fold or more.

There is provided herein a homodimeric multi-domain stack molecule produced from a stack immunomodulatory Fc fusion polypeptide containing an IgSF domain, e.g., IgV domain, of a variant CD80 polypeptide, a second IgSF domain, e.g., IgV, of a variant CD155 or CD112 polypeptide and a third IgSF domain, e.g., IgV, of a variant PD-L1 or PD-L2 polypeptide. In some embodiments, the resulting multi-domain stack molecules bind to CTLA-4, TIGIT, CD112R and PD-1. In some aspects, the binding to CTLA-4 is to the same or similar degree or, in some cases, is increased, compared to the binding to CTLA-4 of the corresponding IgSF domain of unmodified or wild-type CD80. In some aspects, the binding to TIGIT is to the same or similar degree or, in some cases, is increased, compared to the binding to TIGIT of the corresponding IgSF domain of unmodified or wild-type CD155. In some aspects, the binding to CD112R is to the same or similar degree, or, in some cases, is increased, compared to the binding to CD112R of the corresponding IgSF domain of unmodified or wild-type CD112. In some aspects, the binding to PD-1 is to the same or similar degree, or, in some cases, is increased, compared to the binding to PD-1 of the corresponding IgSF domain of unmodified or wild-type PD-L1. In some aspects, the binding to PD-1 is to the same or similar degree, or, in some cases, is increased, compared to the binding to PD-1 of the corresponding IgSF domain of unmodified or wild-type PD-L2. In some embodiments, the binding to CTLA-4 or is at least 30%, 40%, 50%, 60%, 70%, 80%, 90%, or more of the binding to CTLA-4 of the non-stacked form of the variant CD80 IgSF-Fc. In some embodiments, the binding to TIGIT or CD112R is at least 30%, 40%, 50%, 60%, 70%, 80%, 90%, or more of the binding to TIGIT or CD112R of the non-stacked form of the variant CD112 IgSF-Fc. In some embodiments, the binding to TIGIT is at least 30%, 40%, 50%, 60%, 70%, 80%, 90% or more of the binding to TIGIT of the non-stacked form of the variant CD155 IgSF-Fc. In some embodiments, the binding to PD-1 is at least 30%, 40%, 50%, 60%, 70%, 80%, 90% or more of the binding to PD-1 of the non-stacked form of the variant PD-1 IgSF-Fc. In some embodiments, the resulting multi-domain stack molecule increases T cell immune responses compared to the non-stack variant CD80 IgSF-Fc, variant CD112 IgSF-Fc, variant CD155-IgSF-Fc, PD-L1-IgSF-Fc, and/or variant PD-L2-IgSF-Fc, such as determined in a reporter assay. In some embodiments, the increase is greater than 1.2-fold, 1.3-fold, 1.4-fold, 1.5-fold, 2.0-fold, 3.0-fold, 4.0-fold, 5.0-fold or more.

C. Conjugates and Fusions of Variant Polypeptides and Immunomodulatory Proteins In some embodiments, the variant polypeptides provided herein, which are immunomodulatory proteins comprising variants of an Ig domain of the IgSF family (vIgD), can be conjugated with or fused with a moiety, such as an effector moiety, such as another protein, directly or indirectly, to form a conjugate ("IgSF conjugate"). In some embodiments, the attachment can be covalent or non-covalent, e.g., via a biotin-streptavidin non-covalent interaction. In some embodiments of a CD80-Fc variant fusion, any one or combination of any two or more of the foregoing conjugates can be attached to the Fc or to the variant CD80 polypeptide or to both In some embodiments, the moiety can be a targeting moiety, a small molecule drug (non-polypeptide drug of less than 500 Daltons molar mass), a toxin, a cytostatic agent, a cytotoxic agent, an immunosuppressive agent, a radioactive agent suitable for diagnostic purposes, a radioactive metal ion for therapeutic purposes, a prodrug-activating enzyme, an agent that increases biological half-life, or a diagnostic or detectable agent.

In some embodiments, the effector moiety is a therapeutic agent, such as a cancer therapeutic agent, which is either cytotoxic, cytostatic or otherwise provides some therapeutic benefit. In some embodiments, the effector moiety is a targeting moiety or agent, such as an agent that targets a cell surface antigen, e.g., an antigen on the surface of a tumor cell. In some embodiments, the effector moiety is a label, which can generate a detectable signal, either directly or indirectly. In some embodiments, the effector moiety is a toxin. In some embodiments, the effector moiety is a protein, peptide, nucleic acid, small molecule or nanoparticle.

In some embodiments, 1, 2, 3, 4, 5 or more effector moieties, which can be the same or different, are conjugated, linked or fused to the variant polypeptide or protein to form an IgSF conjugate. In some embodiments, such effector moieties can be attached to the variant polypeptide or immunomodulatory protein using various molecular biological or chemical conjugation and linkage methods known in the art and described below. In some embodiments, linkers such as peptide linkers, cleavable linkers, non-cleavable linkers or linkers that aid in the conjugation reaction, can be used to link or conjugate the effector moieties to the variant polypeptide or immunomodulatory protein.

In some embodiments, the IgSF conjugate comprises the following components: (protein or polypeptide), $(L)_q$ and (effector moiety)$_m$, wherein the protein or polypeptide is any of the described variant polypeptides or immunomodulatory proteins capable of binding one or more cognate counter structure ligands as described; L is a linker for linking the protein or polypeptide to the moiety; m is at least 1; q is 0 or more; and the resulting IgSF conjugate binds to the one or more counter structure ligands. In particular embodiments, m is 1 to 4 and q is 0 to 8.

In some embodiments, there is provided an IgSF conjugate comprising a variant polypeptide or immunomodulatory protein provided herein conjugated with a targeting agent that binds to a cell surface molecule, for example, for targeted delivery of the variant polypeptide or immunomodulatory protein to a specific cell. In some embodiments, the targeting agent is a molecule(s) that has the ability to localize and bind to a molecule present on a normal cell/tissue and/or tumor cell/tumor in a subject. In other words, IgSF conjugates comprising a targeting agent can bind to a ligand (directly or indirectly), which is present on a cell, such as a tumor cell. The targeting agents of the invention contemplated for use include antibodies, polypeptides, peptides, aptamers, other ligands, or any combination thereof, that can bind a component of a target cell or molecule.

In some embodiments, the targeting agent binds a tumor cell(s) or can bind in the vicinity of a tumor cell(s) (e.g., tumor vasculature or tumor microenvironment) following administration to the subject. The targeting agent may bind to a receptor or ligand on the surface of the cancer cell. In another aspect of the invention, a targeting agent is selected which is specific for a noncancerous cells or tissue. For example, a targeting agent can be specific for a molecule present normally on a particular cell or tissue. Furthermore, in some embodiments, the same molecule can be present on normal and cancer cells. Various cellular components and molecules are known. For example, if a targeting agent is specific for EGFR, the resulting IgSF conjugate can target cancer cells expressing EGFR as well as normal skin epidermal cells expressing EGFR. Therefore, in some embodiments, an IgSF conjugate of the invention can operate by two separate mechanisms (targeting cancer and non-cancer cells).

In various aspects of the invention disclosed herein an IgSF conjugate of the invention comprises a targeting agent which can bind/target a cellular component, such as a tumor antigen, a bacterial antigen, a viral antigen, a mycoplasma antigen, a fungal antigen, a prion antigen, an antigen from a parasite. In some aspects, a cellular component, antigen or molecule can each be used to mean, a desired target for a targeting agent. For example, in various embodiments, a targeting agent is specific for or binds to a component, which includes but is not limited to, epidermal growth factor receptor (EGFR, ErbB-1, HER), ErbB-2 (HER2/neu), ErbB-3/HER3, ErbB-4/HER4, EGFR ligand family; insulin-like growth factor receptor (IGFR) family, IGF-binding proteins (IGFBPs), IGFR ligand family; platelet derived growth factor receptor (PDGFR) family, PDGFR ligand family; fibroblast growth factor receptor (FGFR) family, FGFR ligand family, vascular endothelial growth factor receptor (VEGFR) family, VEGF family; HGF receptor family; TRK receptor family; ephrin (EPH) receptor family; AXL receptor family; leukocyte tyrosine kinase (LTK) receptor family; TIE receptor family, angiopoietin 1,2; receptor tyrosine kinase-like orphan receptor (ROR) receptor family, e.g., ROR1; CD171 (LlCAM); B7-H6 (NCR3LG1); CD80, tumor glycosylation antigen, e.g., sTn or Tn, such as sTn Ag of MUC1; LHR (LHCGR); phosphatidylserine, discoidin domain receptor (DDR) family; RET receptor family; KLG receptor family; RYK receptor family; MuSK receptor family; Transforming growth factor-α (TGF-α) receptors, TGF-β; Cytokine receptors, Class I (hematopoietin family) and Class II (interferon/IL-10 family) receptors, tumor necrosis factor (TNF) receptor superfamily (TNFRSF), death receptor family; cancer-testis (CT) antigens, lineage-specific antigens, differentiation antigens, alpha-actinin-4, ARTC, breakpoint cluster region-Abelson (Bcr-abl) fusion products, B-RAF, caspase-5 (CASP-5), caspase-8 (CASP-8), O-catenin (CTNNBl), cell division cycle 27 (CDCl27), cyclin-dependent kinase 4 (CDK4), CDKN2A, COA-I, dekcan fusion protein, EFTUD-2, Elongation factor 2 (ELF2), Ets variant gene 6/acute myeloid leukemia 1 gene ETS (ETC6-AML1) fusion protein, fibronectin (FN), e.g., the extradomain A (EDA) of fibronectin, GPNMB, low density lipid receptor/GDP-L fucose: R-D-galactose 2-α-L-fucosyltransferase (LDLR/FUT) fusion protein, HLA-A2. arginine to isoleucine exchange at residue 170 of the α-helix of the α2-domain in the HLA-A2gene (HLA-A*201-R170I), HLA-A1 1, heat shock protein 70-2 mutated (HSP70-2M), K1AA0205, MART2, melanoma ubiquitous mutated 1, 2, 3 (MUM-I, 2, 3), prostatic acid phosphatase (PAP), neo-PAP, Myosin class I, NFYC, OGT, OS-9, pml-RAR fusion protein, PRDX5, PTPRK, K-ras (KRAS2), N-ras (NRAS), HRAS, RBAF600, SIRT2, SNRPDl, SYT-SSXl or -SSX2 fusion protein, Triosephosphate Isomerase, BAGE, BAGK-1, BAGE-2,3,4,5, GAGE-1,2,3,4,5,6,7,8, GnT-V (aberrant N-acetyl glucosaminyl transferase V, MGAT5), HERV-K-MEL, KK-LC, KM-HN-I, LAGE, LAGE-I, CTL-recognized antigen on melanoma (CAMEL), MAGE-A1 (MAGE-I), MAGE-A2, MAGE-A3, MAGE-A4, MAGE-A5, MAGE-A6, MAGE-A8, MAGE-A9, MAGE-AlO, MAGE-Al1, MAGE-A12, MAGE-3, MAGE-B1, MAGE-B2, MAGE-B5, MAGE-B6, MAGE-C1, MAGE-C2, mucin 1 (MUC1), MART-1/Melan-A (MLANA), gplOO, gplOO/Pmell7 (SILV), tyrosinase (TYR), TRP-I, HAGE, NA-88, NY-ESO-I, NY-ESO-l/LAGE-2, SAGE, Spl7, SSX-1,2,3,4, TRP2-INT2, carcino-embryonic antigen (CEA), Kallikrein 4, mammaglobin-A, OAl, prostate specific antigen (PSA), TRP-1/gp75, TRP-2, adipophilin, interferon inducible protein absent in melanoma 2 (AIM-2), BING-4, CPSF, cyclin Dl, epithelial cell adhesion molecule (Ep-CAM), EphA3, fibroblast growth factor-5 (FGF-5), glycoprotein 250 (gp250), EGFR (ERBBl), HER-2/neu (ERBB2), interleukin 13 receptor α2 chain (IL13Rα2), IL-6 receptor, intestinal carboxyl esterase (iCE), alpha-feto protein (AFP), M-CSF, mdm-2, MUCl, p53 (TP53), PBF, PRAME, PSMA, RAGE-I, RNF43, RU2AS, SOXO, STEAPI, survivin (BIRC5), human telomerase reverse transcriptase (hTERT), telomerase, Wilms' tumor gene (WTl), SYCPI, BRDT, SPANX, XAGE, ADAM2, PAGE-5, LIPl, CTAGE-I, CSAGE, MMAI, CAGE, BORIS, HOM-TES-85, AF15q4, HCA661, LDHC, MORC, SGY-I, SPOl 1, TPXl, NY-SAR-35, FTHL17, NXF2, TDRDI, TEX15, FATE, TPTE, immunoglobulin idiotypes, Bence-Jones protein, estrogen receptors (ER), androgen receptors (AR), CD40, CD30, CD20, CD 19, CD33, cancer antigen 72-4 (CA 72-4), cancer antigen 15-3 (CA 15-3), cancer antigen 27-29 (CA 27-29), cancer antigen 125 (CA 125), cancer antigen 19-9 (CA 19-9), 3-human chorionic gonadotropin, β-2 microglobulin, squamous cell carcinoma antigen, neuron-specific enolase, heat shock protein gp96, GM2, sargramostim, CTLA-4, 707 alanine proline (707-AP), adenocarcinoma antigen recognized by T cells 4 (ART-4), carcinoembryonic antigen peptide-1 (CAP-I), calcium-activated chloride channel-2 (CLCA2), cyclophilin B (Cyp-B), human signet ring tumor-2 (HST-2), Human papilloma virus (HPV) proteins (HPV-E6, HPV-E7, major or minor capsid antigens, others), Epstein-Barr virus (EBV) proteins (EBV latent membrane proteins—LMPI, LMP2; others), Hepatitis B or C virus proteins, and HIV proteins.

In some embodiments, an IgSF conjugate, through its targeting agent, will bind a cellular component of a tumor cell, tumor vasculature or tumor microenvironment, thereby promoting killing of targeted cells via modulation of the immune response, (e.g., by activation of co-stimulatory molecules or inhibition of negative regulatory molecules of immune cell activation), inhibition of survival signals (e.g., growth factor or cytokine or hormone receptor antagonists), activation of death signals, and/or immune-mediated cytotoxicity, such as through antibody dependent cellular cytotoxicity. Such IgSF conjugates can function through several mechanisms to prevent, reduce or eliminate tumor cells, such as to facilitate delivery of conjugated effector moieties to the tumor target, such as through receptor-mediated endocytosis of the IgSF conjugate; or such conjugates can recruit, bind, and/or activate immune cells (e.g., NK cells, monocytes/macrophages, dendritic cells, T cells, B cells). Moreover, in some instances one or more of the foregoing pathways may operate upon administration of one or more IgSF conjugates of the invention.

In some embodiments, an IgSF conjugate, through its targeting agent, will be localized to, such as bind to, a cellular component of a tumor cell, tumor vasculature or tumor microenvironment, thereby modulating cells of the immune response in the vicinity of the tumor. In some embodiments, the targeting agent facilitates delivery of the conjugated IgSF (e.g., vIgD) to the tumor target, such as to interact with its cognate binding partner to alter signaling of immune cells (e.g., NK cells, monocytes/macrophages, dendritic cells, T cells, B cells) bearing the cognate binding partner. In some embodiments, localized delivery mediates an antagonizing or blocking activity of the CTLA-4 inhibitory receptor. In some embodiments, localized delivery agonizes the CTLA-4 inhibitory receptor, which, in some cases, can occur where there is proximal clustering of an activating receptor.

In some embodiments, the targeting agent is an immunoglobulin. As used herein, the term "immunoglobulin" includes natural or artificial mono- or polyvalent antibodies including, but not limited to, polyclonal, monoclonal, multispecific, human, humanized or chimeric antibodies, single chain antibodies, Fab fragments, F(ab') fragments, fragments produced by a Fab expression library, single chain Fv (scFv); anti-idiotypic (anti-Id) antibodies (including, e.g., anti-Id antibodies to antibodies of the invention), and epitope-binding fragments of any of the above. The term "antibody," as used herein, refers to immunoglobulin molecules and immunologically active portions of immunoglobulin molecules, e.g., molecules that contain an antigen binding site that immunospecifically binds an antigen. The immunoglobulin molecules of the invention can be of any type (e.g., IgG, IgE, IgM, IgD, IgA, and IgY), class (e.g., IgG1, IgG2, IgG3, IgG4, IgA1, and IgA2) or subclass of immunoglobulin molecule.

In some embodiments, an IgSF conjugate, through its antibody targeting moiety, will bind a cellular component of a tumor cell, tumor vasculature or tumor microenvironment, thereby promoting apoptosis of targeted cells via modulation of the immune response, (e.g., by activation of co-stimulatory molecules or inhibition of negative regulatory molecules of immune cell activation), inhibition of survival signals (e.g., growth factor or cytokine or hormone receptor antagonists), activation of death signals, and/or immune-mediated cytotoxicity, such as through antibody dependent cellular cytotoxicity. Such IgSF conjugates can function through several mechanisms to prevent, reduce or eliminate tumor cells, such as to facilitate delivery of conjugated effector moieties to the tumor target, such as through receptor-mediated endocytosis of the IgSF conjugate; or such conjugates can recruit, bind, and/or activate immune cells (e.g., NK cells, monocytes/macrophages, dendritic cells, T cells, B cells).

In some embodiments, an IgSF conjugate, through its antibody targeting moiety, will bind a cellular component of a tumor cell, tumor vasculature or tumor microenvironment, thereby modulating the immune response (e.g., by activation of co-stimulatory molecules or inhibition of negative regulatory molecules of immune cell activation). In some embodiments, such conjugates can recognize, bind, and/or modulate (e.g., inhibit or activate) immune cells (e.g., NK cells, monocytes/macrophages, dendritic cells, T cells, B cells).

Antibody targeting moieties of the invention include antibody fragments that include, but are not limited to, Fab, Fab' and $F(ab')_2$, Fd, single-chain Fvs (scFv), single-chain antibodies, disulfide-linked Fvs (sdFv) and fragments comprising either a $V_L$ or $V_H$ domain. Antigen-binding antibody fragments, including single-chain antibodies, may comprise the variable region(s) alone or in combination with the entirety or a portion of the following: hinge region, CHI, CH2, and CH3 domains. Also included in the invention are antigen-binding fragments also comprising any combination of variable region(s) with a hinge region, CHI, CH2, and CH3 domains. Also included in the invention are Fc fragments, antigen-Fc fusion proteins, and Fc-targeting moiety conjugates or fusion products (Fc-peptide, Fc-aptamer). The antibody targeting moieties of the invention may be from any animal origin including birds and mammals. In one aspect, the antibody targeting moieties are human, murine (e.g., mouse and rat), donkey, sheep, rabbit, goat, guinea pig, camel, horse, or chicken. Further, such antibodies may be humanized versions of animal antibodies. The antibody targeting moieties of the invention may be monospecific, bispecific, trispecific, or of greater multispecificity.

In various embodiments, an antibody/targeting moiety recruits, binds, and/or activates immune cells (e.g., NK cells, monocytes/macrophages, dendritic cells) via interactions between Fc (in antibodies) and Fc receptors (on immune cells) and via the conjugated variant polypeptides or immunomodulatory proteins provided herein. In some embodiments, an antibody/targeting moiety recognizes or binds a tumor agent via and localizes to the tumor cell the conjugated variant polypeptides or immunomodulatory proteins provided herein to facilitate modulation of immune cells in the vicinity of the tumor.

Examples of antibodies which can be incorporated into IgSF conjugates include but are not limited to antibodies such as Cetuximab (IMC-C225; Erbitux®), Trastuzumab (Herceptin®), Rituximab (Rituxan®; MabThera®), Bevacizumab (Avastin®), Alemtuzumab (Campath®; Campath-1H®; Mabcampath®), Panitumumab (ABX-EGF; Vectibix®), Ranibizumab (Lucentis®), Ibritumomab, Ibritumomab tiuxetan, (Zevalin®), Tositumomab, Iodine I 131 Tositumomab (BEXXAR®), Catumaxomab (Removab®), Gemtuzumab, Gemtuzumab ozogamicine (Mylotarg®), Abatacept (CTLA4-Ig; Orencia®), Belatacept (L104EA29YIg; LEA29Y; LEA), Ipilimumab (MDX-010; MDX-101), Tremelimumab (ticilimumab; CP-675,206), PRS-010, PRS-050, Aflibercept (VEGF Trap, AVE005), Volociximab (M200), F200, MORAb-009, SS1P (CAT-5001), Cixutumumab (IMC-A12), Matuzumab (EMD72000), Nimotuzumab (h-R3), Zalutumumab (HuMax-EGFR), Necitumumab IMC-11F8, mAb806/ch806, Sym004, mAb-425, Panorex @ (17-1A) (murine monoclonal antibody); Panorex @ (17-1A) (chimeric murine monoclonal antibody); IDEC-Y2B8 (murine, anti-CD20 MAb); BEC2 (anti-idiotypic MAb, mimics the GD epitope) (with BCG); Oncolym (Lym-1 monoclonal antibody); SMART M195 Ab, humanized 13'I LYM-I (Oncolym), Ovarex (B43.13, anti-idiotypic mouse MAb); MDX-210 (humanized anti-HER-2 bispecific antibody); 3622W94 MAb that binds to EGP40 (17-1A) pancarcinoma antigen on adenocarcinomas; Anti-VEGF, Zenapax (SMART Anti-Tac (IL-2 receptor); SMART M195 Ab, humanized Ab, humanized); MDX-210 (humanized anti-HER-2 bispecific antibody); MDX-447 (humanized anti-EGF receptor bispecific antibody); NovoMAb-$G_2$ (pancarcinoma specific Ab); TNT (chimeric MAb to histone antigens); TNT (chimeric MAb to histone antigens); Gliomab-H (Monoclon s—Humanized Abs); GNI-250 Mab; EMD-72000 (chimeric-EGF antagonist); LymphoCide (humanized LL2 antibody); and MDX-260 bispecific, targets GD-2, ANA Ab, SMART IDlO Ab, SMART ABL 364 Ab or ImmuRAIT-CEA. As illustrated by the forgoing list, it is conventional to make antibodies to a particular target epitope.

In some embodiments, the antibody targeting moiety is a full length antibody, or antigen-binding fragment thereof, containing an Fc domain. In some embodiments, the variant polypeptide or immunomodulatory protein is conjugated to the Fc portion of the antibody targeting moiety, such as by conjugation to the N-terminus of the Fc portion of the antibody.

Figures 8A, 8B:
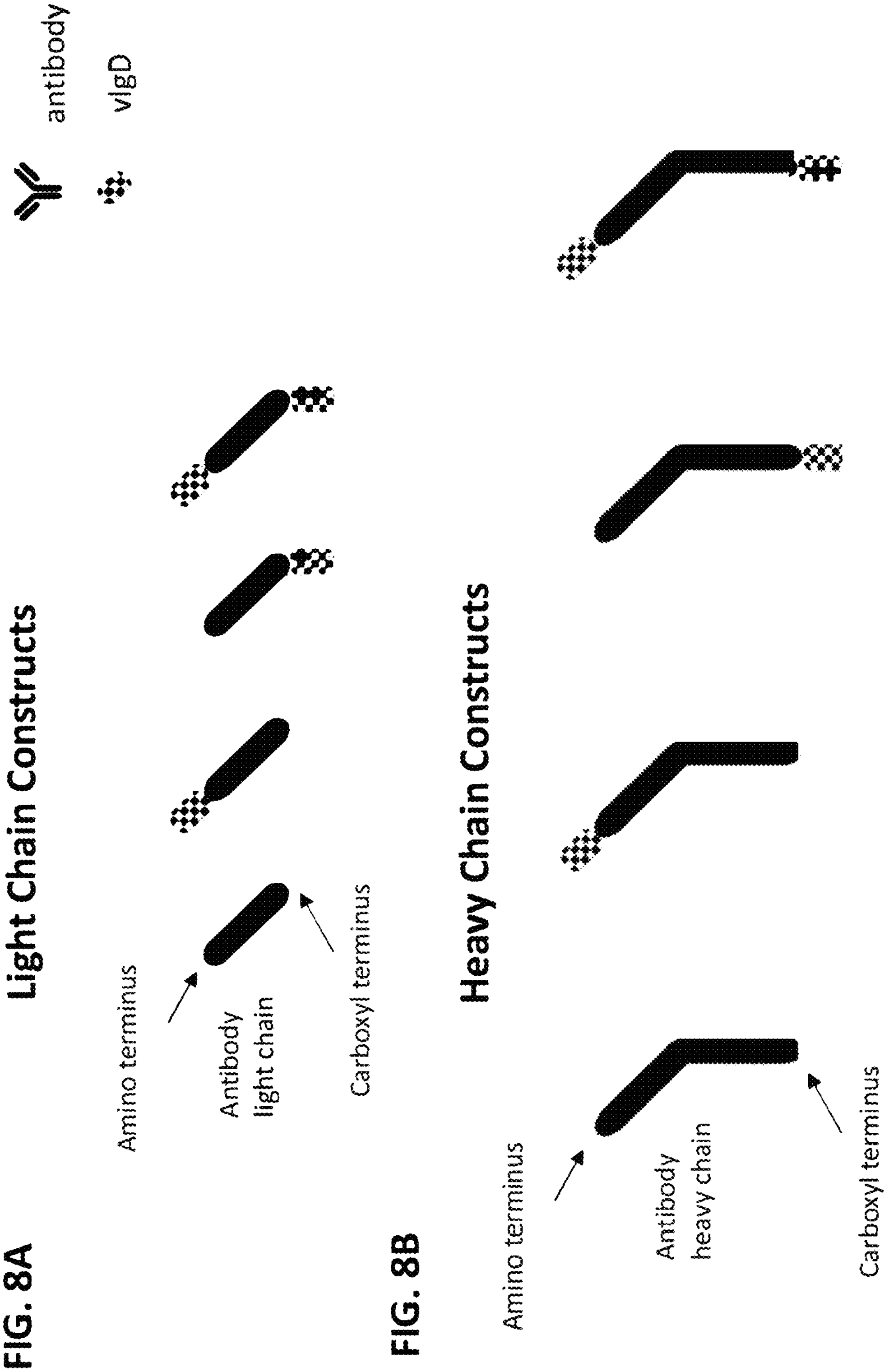
FIG. 8A-8C depict various exemplary configurations of a variant IgSF-antibody conjugate (V-Mab).
Figure 8C:
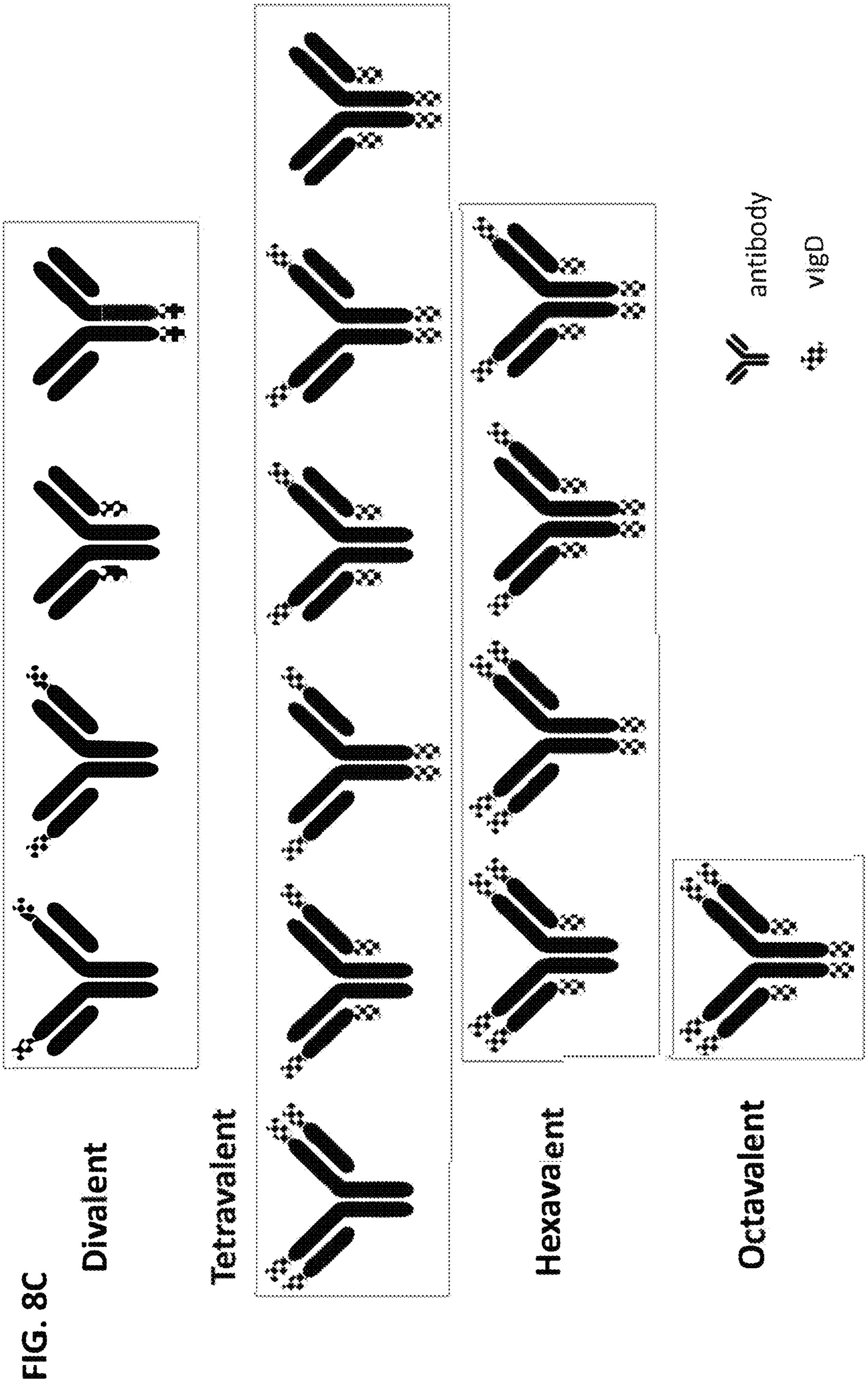

In some embodiments, the vIgD is linked, directly or indirectly, to the N- or C-terminus of the light and/or heavy chain of the antibody. In some embodiments, linkage can be via a peptide linker, such as any described above. Various configurations can be constructed. FIGS. 8A-8C depict exemplary configurations. In some embodiments, the antibody conjugate can be produced by co-expression of the heavy and light chain of the antibody in a cell.

In one aspect of the invention, the targeting agent is an aptamer molecule. For example, in some embodiments, the aptamer is comprised of nucleic acids that function as a targeting agent. In various embodiments, an IgSF conjugate of the invention comprises an aptamer that is specific for a molecule on a tumor cell, tumor vasculature, and/or a tumor microenvironment. In some embodiments, the aptamer itself can comprise a biologically active sequence, in addition to the targeting module (sequence), wherein the biologically active sequence can induce an immune response to the target cell. In other words, such an aptamer molecule is a dual use agent. In some embodiments, an IgSF conjugate of the invention comprises conjugation of an aptamer to an antibody, wherein the aptamer and the antibody are specific for binding to separate molecules on a tumor cell, tumor vasculature, tumor microenvironment, and/or immune cells.

The term "aptamer" includes DNA, RNA or peptides that are selected based on specific binding properties to a particular molecule. For example, an aptamer(s) can be selected for binding a particular gene or gene product in a tumor cell, tumor vasculature, tumor microenvironment, and/or an immune cell, as disclosed herein, where selection is made by methods known in the art and familiar to one of skill in the art.

In some aspects of the invention the targeting agent is a peptide. For example, the variant polypeptides or immunomodulatory proteins provided herein can be conjugated to a peptide which can bind with a component of a cancer or tumor cells. Therefore, such IgSF conjugates of the invention comprise peptide targeting agents which binds to a cellular component of a tumor cell, tumor vasculature, and/or a component of a tumor microenvironment. In some embodiments, targeting agent peptides can be an antagonist or agonist of an integrin. Integrins, which comprise an alpha and a beta subunit, include numerous types well known to a skilled artisan.

In one embodiment, the targeting agent is Vvβ3. Integrin Vvβ3 is expressed on a variety of cells and has been shown to mediate several biologically relevant processes, including adhesion of osteoclasts to bone matrix, migration of vascular smooth muscle cells, and angiogenesis. Suitable targeting molecules for integrins include RGD peptides or peptidomimetics as well as non-RGD peptides or peptidomimetics (see, e.g., U.S. Pat. Nos. 5,767,071 and 5,780,426) for other integrins such as V4.βi (VLA-4), V4-P7 (see, e.g., U.S. Pat. No. 6,365,619; Chang et al, Bioorganic & Medicinal Chem Lett, 12:159-163 (2002); Lin et al., Bioorganic & Medicinal Chem Lett, 12:133-136 (2002)), and the like.

In some embodiments, there is provided an IgSF conjugate comprising a variant polypeptide or immunomodulatory protein provided herein conjugated with a therapeutic agent. In some embodiments, the therapeutic agent includes, for example, daunomycin, doxorubicin, methotrexate, and vindesine (Rowland et al., Cancer Immunol. Immunother. 21:183-187, 1986). In some embodiments, the therapeutic agent has an intracellular activity. In some embodiments, the IgSF conjugate is internalized and the therapeutic agent is a cytotoxin that blocks the protein synthesis of the cell, therein leading to cell death. In some embodiments, the therapeutic agent is a cytotoxin comprising a polypeptide having ribosome-inactivating activity including, for example, gelonin, bouganin, saporin, ricin, ricin A chain, bryodin, diphtheria toxin, restrictocin, *Pseudomonas* exotoxin A and variants thereof. In some embodiments, where the therapeutic agent is a cytotoxin comprising a polypeptide having a ribosome-inactivating activity, the IgSF conjugate must be internalized upon binding to the target cell in order for the protein to be cytotoxic to the cells.

In some embodiments, there is provided an IgSF conjugate comprising a variant polypeptide or immunomodulatory protein provided herein conjugated with a toxin. In some embodiments, the toxin includes, for example, bacterial toxins such as diphtheria toxin, plant toxins such as ricin, small molecule toxins such as geldanamycin (Mandler et al., J. Nat. Cancer Inst. 92(19):1573-1581 (2000); Mandler et al., Bioorganic & Med. Chem. Letters 10:1025-1028 (2000); Mandler et al., Bioconjugate Chem. 13:786-79I (2002)), maytansinoids (EP 1391213; Liu et al., Proc. Natl. Acad. Sci. USA 93:8618-8623 (1996)), and calicheamicin (Lode et al., Cancer Res. 58:2928 (1998); Hinman et al., Cancer Res. 53:3336-3342 (1993)). The toxins may exert their cytotoxic and cytostatic effects by mechanisms including tubulin binding, DNA binding, or topoisomerase inhibition.

In some embodiments, there is provided an IgSF conjugate comprising a variant polypeptide or immunomodulatory protein provided herein conjugated with a label, which can generate a detectable signal, indirectly or directly. These IgSF conjugates can be used for research or diagnostic applications, such as for the in vivo detection of cancer. The label is preferably capable of producing, either directly or indirectly, a detectable signal. For example, the label may be radio-opaque or a radioisotope, such as 3H, 14C, 32P, 35S, 123, 1251, 131I; a fluorescent (fluorophore) or chemiluminescent (chromophore) compound, such as fluorescein isothiocyanate, rhodamine or luciferin; an enzyme, such as alkaline phosphatase, O-galactosidase or horseradish peroxidase; an imaging agent; or a metal ion. In some embodiments, the label is a radioactive atom for scintigraphic studies, for example 99Tc or 1231, or a spin label for nuclear magnetic resonance (NMR) imaging (also known as magnetic resonance imaging, MRI), such as zirconium-89, iodine-123, iodine-131, indium-111, fluorine-19, carbon-13, nitrogen-15, oxygen-17, gadolinium, manganese or iron. Zirconium-89 may be complexed to various metal chelating agents and conjugated to antibodies, e.g., for PET imaging (WO 2011/056983). In some embodiments, the IgSF conjugate is detectable indirectly. For example, a secondary antibody that is specific for the IgSF conjugate and contains a detectable label can be used to detect the IgSF conjugate.

The IgSF conjugates may be prepared using any methods known in the art. See, e.g., WO 2009/067800, WO 2011/133886, and U.S. Patent Application Publication No. 2014322129, incorporated by reference herein in their entirety.

The variant polypeptides or immunomodulatory proteins of an IgSF conjugate may be "attached to" the effector moiety by any means by which the variant polypeptides or immunomodulatory proteins can be associated with, or linked to, the effector moiety. For example, the variant polypeptides or immunomodulatory proteins of an IgSF conjugate may be attached to the effector moiety by chemical or recombinant means. Chemical means for preparing fusions or conjugates are known in the art and can be used to prepare the IgSF conjugate. The method used to conjugate the variant polypeptides or immunomodulatory proteins and effector moiety must be capable of joining the variant polypeptides or immunomodulatory proteins with the effector moiety without interfering with the ability of the variant polypeptides or immunomodulatory proteins to bind to their one or more counter structure ligands.

The variant polypeptides or immunomodulatory proteins of an IgSF conjugate may be linked indirectly to the effector moiety. For example, the variant polypeptides or immunomodulatory proteins of an IgSF conjugate may be directly linked to a liposome containing the effector moiety of one of several types. The effector moiety(s) and/or the variant polypeptides or immunomodulatory proteins may also be bound to a solid surface.

In some embodiments, the variant polypeptides or immunomodulatory proteins of an IgSF conjugate and the effector moiety are both proteins and can be conjugated using techniques well known in the art. There are several hundred crosslinkers available that can conjugate two proteins. (See for example "Chemistry of Protein Conjugation and Crosslinking," 1991, Shans Wong, CRC Press, Ann Arbor). The crosslinker is generally chosen based on the reactive functional groups available or inserted on the variant polypeptides or immunomodulatory proteins and/or effector moiety. In addition, if there are no reactive groups, a photoactivatable crosslinker can be used. In certain instances, it may be desirable to include a spacer between the variant polypeptides or immunomodulatory proteins and the effector moiety. Crosslinking agents known to the art include the homobifunctional agents: glutaraldehyde, dimethyladipimidate and Bis(diazobenzidine) and the heterobifunctional agents: m Maleimidobenzoyl-N-Hydroxysuccinimide and Sulfo-m Maleimidobenzoyl-N-Hydroxysuccinimide.

In some embodiments, the variant polypeptides or immunomodulatory proteins of an IgSF conjugate may be engineered with specific residues for chemical attachment of the effector moiety. Specific residues used for chemical attachment of molecule known to the art include lysine and cysteine. The crosslinker is chosen based on the reactive functional groups inserted on the variant polypeptides or immunomodulatory proteins, and available on the effector moiety.

An IgSF conjugate may also be prepared using recombinant DNA techniques. In such a case a DNA sequence encoding the variant polypeptides or immunomodulatory proteins is fused to a DNA sequence encoding the effector moiety, resulting in a chimeric DNA molecule. The chimeric DNA sequence is transfected into a host cell that expresses the fusion protein. The fusion protein can be recovered from the cell culture and purified using techniques known in the art.

Examples of attaching an effector moiety, which is a label, to the variant polypeptides or immunomodulatory proteins include the methods described in Hunter, et al., Nature 144:945 (1962); David, et al., Biochemistry 13:1014 (1974); Pain, et al., J. Immunol. Meth. 40:219 (1981); Nygren, J. Histochem. and Cytochem. 30:407 (1982); Wensel and Meares, Radioimmunoimaging And Radioimmunotherapy, Elsevier, N.Y. (1983); and Colcher et al., "Use Of Monoclonal Antibodies As Radiopharmaceuticals For The Localization Of Human Carcinoma Xenografts In Athymic Mice", Meth. Enzymol., 121:802-16 (1986).

The radio- or other labels may be incorporated in the conjugate in known ways. For example, the peptide may be biosynthesized or may be synthesized by chemical amino acid synthesis using suitable amino acid precursors involving, for example, fluorine-19 in place of hydrogen. Labels such as 99Tc or 1231, 186Re, 188Re and 111In can be attached via a cysteine residue in the peptide. Yttrium-90 can be attached via a lysine residue. The IODOGEN method (Fraker et al., Biochem. Biophys. Res. Commun. 80:49-57 (1978)) can be used to incorporate iodine-123. "Monoclonal Antibodies in Immunoscintigraphy" (Chatal, CRC Press 1989) describes other methods in detail.

Conjugates of the variant polypeptides or immunomodulatory proteins and a cytotoxic agent may be made using a variety of bifunctional protein coupling agents such as N-succinimidyl-3-(2-pyridyldithio) propionate (SPDP), succinimidyl-4-(N-maleimidomethyl) cyclohexane-1-carboxylate (SMCC), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). For example, a ricin immunotoxin can be prepared as described in Vitetta et al., Science 238:1098 (1987). Carbon-14-labeled 1-p-isothiocyanatobenzyl-3-methyldiethylenetriaminepentaacetic acid (MX-DTPA) is an exemplary chelating agent for conjugation of radionucleotide to the antibody. See, e.g., WO94/11026. The linker may be a "cleavable linker" facilitating release of the cytotoxic drug in the cell. For example, an acid-labile linker, peptidase-sensitive linker, photolabile linker, dimethyl linker or disulfide-containing linker (Chari et al., Cancer Research 52:127-131 (1992); U.S. Pat. No. 5,208,020) may be used.

The IgSF conjugates of the invention expressly contemplate, but are not limited to, drug conjugates prepared with cross-linker reagents: BMPS, EMCS, GMBS, HBVS, LC-SMCC, MBS, MPBH, SBAP, SIA, SIAB, SMCC, SMPB, SMPH, sulfo-EMCS, sulfo-GMBS, sulfo-KMUS, sulfo-MBS, sulfo-SIAB, sulfo-SMCC, and sulfo-SMPB, and SVSB (succinimidyl-(4-vinylsulfone)benzoate) which are commercially available (e.g., from Pierce Biotechnology, Inc., Rockford, Ill., U.S.A). See pages 467-498, 2003-2004 Applications Handbook and Catalog.

D. Transmembrane and Secretable Immunomodulatory Proteins and Engineered Cells Provided herein are engineered cells which express the immunomodulatory variant CD80 polypeptides (alternatively, "engineered cells"). In some embodiments, the expressed immunomodulatory variant CD80 polypeptide is a transmembrane protein and is surface expressed. In some embodiments, the expressed immunomodulatory variant CD80 polypeptide is expressed and secreted from the cell.

1. Transmembrane Immunomodulatory Proteins

In some embodiments, an immunomodulatory polypeptide comprising a variant CD80 can be a membrane bound protein. As described in more detail below, the immunomodulatory polypeptide can be a transmembrane immunomodulatory polypeptide comprising a variant CD80 in which is contained: an ectodomain containing at least one affinity modified IgSF domain (IgV or IgC), a transmembrane domain and, optionally, a cytoplasmic domain. In some embodiments, the transmembrane immunomodulatory protein can be expressed on the surface of an immune cell, such as a mammalian cell, including on the surface of a lymphocyte (e.g., T cell or NK cell) or antigen presenting cell. In some embodiments, the transmembrane immunomodulatory protein is expressed on the surface of a mammalian T-cell, including such T-cells as: a T helper cell, a cytotoxic T-cell (alternatively, cytotoxic T lymphocyte or CTL), a natural killer T-cell, a regulatory T-cell, a memory T-cell, or a gamma delta T-cell. In some embodiments, the mammalian cell is an antigen presenting cell (APC). Typically, but not exclusively, the ectodomain (alternatively, "extracellular domain") of comprises the one or more amino acid variations (e.g., amino acid substitutions) of the variant CD80 of the invention. Thus, for example, in some embodiments a transmembrane protein will comprise an ectodomain that comprises one or more amino acid substitutions of a variant CD80 of the invention.

In some embodiments, the engineered cells express a variant CD80 polypeptides are transmembrane immunomodulatory polypeptides (TIPs) that can be a membrane protein such as a transmembrane protein. In typical embodiments, the ectodomain of a membrane protein comprises an extracellular domain or IgSF domain thereof of a variant CD80 provided herein in which is contained one or more amino acid substitutions in at least one IgSF domain as described. The transmembrane immunomodulatory proteins provided herein further contain a transmembrane domain linked to the ectodomain. In some embodiments, the transmembrane domain results in an encoded protein for cell surface expression on a cell. In some embodiments, the transmembrane domain is linked directly to the ectodomain. In some embodiments, the transmembrane domain is linked indirectly to the ectodomain via one or more linkers or spacers. In some embodiments, the transmembrane domain contains predominantly hydrophobic amino acid residues, such as leucine and valine.

In some embodiments, a full length transmembrane anchor domain can be used to ensure that the TIPs will be expressed on the surface of the engineered cell, such as engineered T cell. Conveniently, this could be from a particular native protein that is being affinity modified (e.g., CD80 or other native IgSF protein), and simply fused to the sequence of the first membrane proximal domain in a similar fashion as the native IgSF protein (e.g., CD80). In some embodiments, the transmembrane immunomodulatory protein comprises a transmembrane domain of the corresponding wild-type or unmodified IgSF member, such as a transmembrane domain contained in the sequence of amino acids set forth in SEQ ID NO:1 (Table 3). In some embodiments, the membrane bound form comprises a transmembrane domain of the corresponding wild-type or unmodified polypeptide, such as corresponding to residues 243-263 of SEQ ID NO:1.

In some embodiments, the transmembrane domain is a non-native transmembrane domain that is not the transmembrane domain of native CD80. In some embodiments, the transmembrane domain is derived from a transmembrane domain from another non-CD80 family member polypeptide that is a membrane-bound or is a transmembrane protein. In some embodiments, a transmembrane anchor domain from another protein on T cells can be used. In some embodiments, the transmembrane domain is derived from CD8. In some embodiments, the transmembrane domain can further contain an extracellular portion of CD8 that serves as a spacer domain. An exemplary CD8 derived transmembrane domain is set forth in SEQ ID NO: 332, 364, or 1997 or a portion thereof containing the CD8 transmembrane domain. In some embodiments, the transmembrane domain is a synthetic transmembrane domain.

In some embodiments, the transmembrane immunomodulatory protein further contains an endodomain, such as a cytoplasmic signaling domain, linked to the transmembrane domain. In some embodiments, the cytoplasmic signaling domain induces cell signaling. In some embodiments, the endodomain of the transmembrane immunomodulatory protein comprises the cytoplasmic domain of the corresponding wild-type or unmodified polypeptide, such as a cytoplasmic domain contained in the sequence of amino acids set forth in SEQ ID NO:1 (see Table 3).

In some embodiments, a provided transmembrane immunomodulatory protein that is or comprises a variant CD80 comprises a sequence of amino acids that exhibits at least 85%, 86%, 87%, 88%, 89%, 90%, 91%, 92%, 93%, 94%, 95%, 96%, 97%, 98% or 99% sequence identity to SEQ ID NO: 279 and contains an ectodomain comprising at least one affinity-modified CD80 IgSF domain as described and a transmembrane domain. In some embodiments, the transmembrane immunomodulatory protein contains any one or more amino acid substitutions in an IgSF domain (e.g., IgV domain) as described, including any set forth in Table 1. In some embodiments, the transmembrane immunomodulatory protein can further comprise a cytoplasmic domain as described. In some embodiments, the transmembrane immunomodulatory protein can further contain a signal peptide. In some embodiments, the signal peptide is the native signal peptide of wild-type IgSF member, such as contained in the sequence of amino acids set forth in SEQ ID NO:1 (see e.g., Table 3).

Also provided is a nucleic acid molecule encoding such transmembrane immunomodulatory proteins. In some embodiments, a nucleic acid molecule encoding a transmembrane immunomodulatory protein comprises a nucleotide sequence that encodes a sequence of amino acids that exhibits at least 85%, 86%, 87%, 88%, 89%, 90%, 91%, 92%, 93%, 94%, 95%, 96%, 97%, 98% or 99% sequence identity to SEQ ID NOS: 279 and contains an ectodomain comprising at least one affinity-modified IgSF domain as described, a transmembrane domain and, optionally, a cytoplasmic domain. In some embodiments, the nucleic acid molecule can further comprise a sequence of nucleotides encoding a signal peptide. In some embodiments, the signal peptide is the native signal peptide of the corresponding wild-type IgSF member (see e.g., Table 3).

In some embodiments, provided are CAR-related transmembrane immunomodulatory proteins in which the endodomain of a transmembrane immunomodulatory protein comprises a cytoplasmic signaling domain that comprises at least one ITAM (immunoreceptor tyrosine-based activation motif)-containing signaling domain. ITAM is a conserved motif found in a number of protein signaling domains involved in signal transduction of immune cells, including in the CD3-zeta chain ("CD3-z") involved in T-cell receptor signal transduction. In some embodiments, the endodomain comprises at CD3-zeta signaling domain. In some embodiments, the CD3-zeta signaling domain comprises the sequence of amino acids set forth in SEQ ID NO: 333 or a sequence of amino acids that exhibits at least 85%, 86%, 87%, 88%, 89%, 90%, 91%, 92%, 93%, 94%, 95%, 96%, 97%, 98% or 99% to SEQ ID NO:333 and retains the activity of T cell signaling. In some embodiments, the endodomain of a CAR-related transmembrane immunomodulatory protein can further comprise a costimulatory signaling domain to further modulate immunomodulatory responses of the T-cell. In some embodiments, the costimulatory signaling domain is CD28, ICOS, 41BB or OX40. In some embodiments, the costimulatory signaling domain is a derived from CD28 or 4-1BB and comprises the sequence of amino acids set forth in any of SEQ ID NOS: 365-368 or a sequence of amino acids that exhibits at least 85%, 86%, 87%, 88%, 89%, 90%, 91%, 92%, 93%, 94%, 95%, 96%, 97%, 98% or 99% to SEQ ID NO:365-368 and retains the activity of T cell costimulatory signaling. In some embodiments, the provided CAR-related transmembrane immunomodulatory proteins have features of CARs to stimulate T cell signaling upon binding of an affinity modified IgSF domain to a cognate binding partner or counter structure. In some embodiments, upon specific binding by the affinity-modified IgSF domain to its counter structure can lead to changes in the immunological activity of the T-cell activity as reflected by changes in cytotoxicity, proliferation or cytokine production.

In some embodiments, the transmembrane immunomodulatory protein does not contain an endodomain capable of mediating cytoplasmic signaling. In some embodiments, the transmembrane immunomodulatory protein lacks the signal transduction mechanism of the wild-type or unmodified polypeptide and therefore does not itself induce cell signaling. In some embodiments, the transmembrane immunomodulatory protein lacks an intracellular (cytoplasmic) domain or a portion of the intracellular domain of the corresponding wild-type or unmodified polypeptide, such as a cytoplasmic signaling domain contained in the sequence of amino acids set forth in SEQ ID NO:1 (see Table 2). In some embodiments, the transmembrane immunomodulatory protein does not contain an ITIM (immunoreceptor tyrosine-based inhibition motif), such as contained in certain inhibitory receptors, including inhibitory receptors of the IgSF family (e.g., PD-1 or TIGIT). Thus, in some embodiments, the transmembrane immunomodulatory protein only contains the ectodomain and the transmembrane domain, such as any as described.

2. Secreted Immunomodulatory Proteins and Engineered Cells

In some embodiments, the CD80 variant immunomodulatory polypeptide containing any one or more of the amino acid mutations as described herein, is secretable, such as when expressed from a cell. Such a variant CD80 immunomodulatory protein does not comprise a transmembrane domain. In some embodiments, the variant CD80 immunomodulatory protein is not conjugated to a half-life extending moiety (such as an Fc domain or a multimerization domain). In some embodiments, the variant CD80 immunomodulatory protein comprises a signal peptide, e.g., an antibody signal peptide or other efficient signal sequence to get domains outside of cell. When the immunomodulatory protein comprises a signal peptide and is expressed by an engineered cell, the signal peptide causes the immunomodulatory protein to be secreted by the engineered cell. Generally, the signal peptide, or a portion of the signal peptide, is cleaved from the immunomodulatory protein with secretion. The immunomodulatory protein can be encoded by a nucleic acid (which can be part of an expression vector). In some embodiments, the immunomodulatory protein is expressed and secreted by a cell (such as an immune cell, for example a primary immune cell).

Thus, in some embodiments, there are provided variant CD80 immunomodulatory proteins that further comprises a signal peptide. In some embodiments, provided herein is a nucleic acid molecule encoding the variant CD80 immunomodulatory protein operably connected to a secretion sequence encoding the signal peptide.

A signal peptide is a sequence on the N-terminus of an immunomodulatory protein that signals secretion of the immunomodulatory protein from a cell. In some embodiments, the signal peptide is about 5 to about 40 amino acids in length (such as about 5 to about 7, about 7 to about 10, about 10 to about 15, about 15 to about 20, about 20 to about 25, or about 25 to about 30, about 30 to about 35, or about 35 to about 40 amino acids in length).

In some embodiments, the signal peptide is a native signal peptide from the corresponding wild-type CD80 (see Table 2). In some embodiments, the signal peptide is a non-native signal peptide. For example, in some embodiments, the non-native signal peptide is a mutant native signal peptide from the corresponding wild-type CD80, and can include one or more (such as 2, 3, 4, 5, 6, 7, 8, 9, or 10 or more) substitutions insertions or deletions. In some embodiments, the non-native signal peptide is a signal peptide or mutant thereof of a family member from the same IgSF family as the wild-type IgSF family member. In some embodiments, the non-native signal peptide is a signal peptide or mutant thereof from an IgSF family member from a different IgSF family that the wild-type IgSF family member. In some embodiments, the signal peptide is a signal peptide or mutant thereof from a non-IgSF protein family, such as a signal peptide from an immunoglobulin (such as IgG heavy chain or IgG-kappa light chain), a cytokine (such as interleukin-2 (IL-2), or CD33), a serum albumin protein (e.g., HSA or albumin), a human azurocidin preprotein signal sequence, a luciferase, a trypsinogen (e.g., chymotrypsinogen or trypsinogen) or other signal peptide able to efficiently secrete a protein from a cell. Exemplary signal peptides include any described in the Table 9.

TABLE 9

Exemplary Signal Peptides

| SEQ ID NO | Signal Peptide | Peptide Sequence |
|---|---|---|
| SEQ ID NO: 311 | HSA signal peptide | MKWVTFISLLFLFSSAYS |
| SEQ ID NO: 312 | Ig kappa light chain | MDMRAPAGIFGFLLVLFPGYRS |
| SEQ ID NO: 313 | human azurocidin preprotein signal sequence | MTRLTVLALLAGLLASSRA |
| SEQ ID NO: 314 | IgG heavy chain signal peptide | MELGLSWIFLLAILKGVQC |
| SEQ ID NO: 315 | IgG heavy chain signal peptide | MELGLRWVFLVAILEGVQC |
| SEQ ID NO: 316 | IgG heavy chain signal peptide | MKHLWFFLLLVAAPRWVLS |
| SEQ ID NO: 317 | IgG heavy chain signal peptide | MDWTWRILFLVAAATGAHS |
| SEQ ID NO: 318 | IgG heavy chain signal peptide | MDWTWRFLFVVAAATGVQS |
| SEQ ID NO: 319 | IgG heavy chain signal peptide | MEFGLSWLFLVAILKGVQC |
| SEQ ID NO: 310 | IgG heavy chain signal peptide | MEFGLSWVFLVALFRGVQC |
| SEQ ID NO: 311 | IgG heavy chain signal peptide | MDLLHKNMKHLWFFLLLVAAPRWVLS |
| SEQ ID NO: 312 | IgG Kappa light chain signal sequences: | MDMRVPAQLLGLLLLWLSGARC |
| SEQ ID NO: 313 | IgG Kappa light chain signal sequences: | MKYLLPTAAAGLLLLAAQPAMA |

TABLE 9-continued

| Exemplary Signal Peptides | | |
|---|---|---|
| SEQ ID NO | Signal Peptide | Peptide Sequence |
| SEQ ID NO: 314 | Gaussia luciferase | MGVKVLFALICIAVAEA |
| SEQ ID NO: 315 | Human albumin | MKWVTFISLLFLFSSAYS |
| SEQ ID NO: 316 | Human chymotrypsinogen | MAFLWLLSCWALLGTTFG |
| SEQ ID NO: 317 | Human interleukin-2 | MQLLSCIALILALV |
| SEQ ID NO: 318 | Human trypsinogen-2 | MNLLLILTFVAAAVA |

In some embodiments of a secretable variant CD80 immunomodulatory protein, the immunomodulatory protein comprises a signal peptide when expressed, and the signal peptide (or a portion thereof) is cleaved from the immunomodulatory protein upon secretion.

In some embodiments, the engineered cells express variant CD80 polypeptides that are secreted from the cell. In some embodiments, such a variant CD80 polypeptide is encoded by a nucleic acid molecule encoding an immunomodulatory protein under the operable control of a signal sequence for secretion. In some embodiments, the encoded immunomodulatory protein is secreted when expressed from a cell. In some embodiments, the immunomodulatory protein encoded by the nucleic acid molecule does not comprise a transmembrane domain. In some embodiments, the immunomodulatory protein encoded by the nucleic acid molecule does not comprise a half-life extending moiety (such as an Fc domain or a multimerization domain). In some embodiments, the immunomodulatory protein encoded by the nucleic acid molecule comprises a signal peptide. In some embodiments, a nucleic acid of the invention further comprises nucleotide sequence that encodes a secretory or signal peptide operably linked to the nucleic acid encoding the immunomodulatory protein, thereby allowing for secretion of the immunomodulatory protein 3. Cells and Engineering Cells Provided herein are engineered cells expressing any of the provided immunomodulatory polypeptide. In some embodiments, the engineered cells express on their surface any of the provided transmembrane immunomodulatory polypeptides. In some embodiments, the engineered cells express and are capable of or are able to secrete the immunomodulatory protein from the cells under conditions suitable for secretion of the protein. In some embodiments, the immunomodulatory protein is expressed on a lymphocyte such as a tumor infiltrating lymphocyte (TIL), T-cell or NK cell, or on a myeloid cell. In some embodiments, the engineered cells are antigen presenting cells (APCs). In some embodiments, the engineered cells are engineered mammalian T-cells or engineered mammalian antigen presenting cells (APCs). In some embodiments, the engineered T-cells or APCs are human or murine cells.

In some embodiments, engineered T-cells include, but are not limited to, T helper cell, cytotoxic T-cell (alternatively, cytotoxic T lymphocyte or CTL), natural killer T-cell, regulatory T-cell, memory T-cell, or gamma delta T-cell. In some embodiments, the engineered T cells are CD4+ or CD8+. In addition to the signal of the MHC, engineered T-cells also require a co-stimulatory signal. Inn some embodiments, engineered T cells also can be modulated by inhibitory signals, which, in some cases, is provided by a variant CD80 transmembrane immunomodulatory polypeptide expressed in membrane bound form as discussed previously.

In some embodiments, the engineered APCs include, for example, MHC II expressing APCs such as macrophages, B cells, and dendritic cells, as well as artificial APCs (aAPCs) including both cellular and acellular (e.g., biodegradable polymeric microparticles) aAPCs. Artificial APCs (aAPCs) are synthetic versions of APCs that can act in a similar manner to APCs in that they present antigens to T-cells as well as activate them. Antigen presentation is performed by the MHC (Class I or Class II). In some embodiments, in engineered APCs such as aAPCs, the antigen that is loaded onto the MHC is, in some embodiments, a tumor specific antigen or a tumor associated antigen. The antigen loaded onto the MHC is recognized by a T-cell receptor (TCR) of a T cell, which, in some cases, can express CTLA-4, CD28, PD-L1 or other molecules recognized by the variant CD80 polypeptides provided herein. Materials which can be used to engineer an aAPC include: poly (glycolic acid), poly (lactic-co-glycolic acid), iron-oxide, liposomes, lipid bilayers, sepharose, and polystyrene.

In some embodiments a cellular aAPC can be engineered to contain a TIP and TCR agonist which is used in adoptive cellular therapy. In some embodiments, a cellular aAPC can be engineered to contain a TIP and TCR agonist which is used in ex vivo expansion of human T cells, such as prior to administration, e.g., for reintroduction into the patient. In some aspects, the aAPC may include expression of at least one anti-CD3 antibody clone, e.g., such as, for example, OKT3 and/or UCHT1. In some aspects, the aAPCs may be inactivated (e.g., irradiated). In some embodiment, the TIP can include any variant IgSF domain that exhibits binding affinity for a cognate binding partner on a T cell.

In some embodiments, an immunomodulatory protein provided herein, such as a transmembrane immunomodulatory protein or a secretable immunomodulatory protein, is co-expressed or engineered into a cell that expresses an antigen-binding receptor, such as a recombinant receptor, such as a chimeric antigen receptor (CAR) or T cell receptor (TCR). In some embodiments, the engineered cell, such as an engineered T cell, recognizes a desired antigen associated with cancer, inflammatory and autoimmune disorders, or a viral infection. In specific embodiments, the antigen-binding receptor contains an antigen-binding moiety that specifically binds a tumor specific antigen or a tumor associated antigen. In some embodiments, the engineered T-cell is a CAR (chimeric antigen receptor) T-cell that contains an antigen-binding domain (e.g., scFv) that specifically binds to an antigen, such as a tumor specific antigen or tumor associated antigen. In some embodiments, the TIP protein is expressed in an engineered T-cell receptor cell or an engineered chimeric antigen receptor cell. In such embodiments, the engineered cell co-expresses the TIP and the CAR or TCR. In some embodiments, the SIP protein is expressed in an engineered T-cell receptor cell or an engineered chimeric antigen receptor cell. In such embodiments, the engineered cell co-expresses the SIP and the CAR or TCR.

Chimeric antigen receptors (CARs) are recombinant receptors that include an antigen-binding domain (ectodomain), a transmembrane domain and an intracellular signaling region (endodomain) that is capable of inducing or mediating an activation signal to the T cell after the antigen is bound. In some example, CAR-expressing cells are engineered to express an extracellular single chain variable fragment (scFv) with specificity for a particular tumor antigen linked to an intracellular signaling part comprising an activating domain and, in some cases, a costimulatory domain. The costimulatory domain can be derived from, e.g., CD28, OX-40, 4-1BB/CD137, inducible T cell costimulator (ICOS), The activating domain can be derived from, e.g., CD3, such as CD3 zeta, epsilon, delta, gamma, or the like. In certain embodiments, the CAR is designed to have two, three, four, or more costimulatory domains. The CAR scFv can be designed to target an antigen expressed on a cell associated with a disease or condition, e.g., a tumor antigen, such as, for example, CD19, which is a transmembrane protein expressed by cells in the B cell lineage, including all normal B cells and B cell malignances, including but not limited to NHL, CLL, and non-T cell ALL. Example CAR+ T cell therapies and constructs are described in U.S. Patent Publication Nos. 2013/0287748, 2014/0227237, 2014/0099309, and 2014/0050708, and these references are incorporated by reference in their entirety.

In some aspects, the antigen-binding domain is an antibody or antigen-binding fragment thereof, such as a single chain fragment (scFv). In some embodiments, the antigen is expressed on a tumor or cancer cell. Exemplary of an antigen is CD19. Exemplary of a CAR is an anti-CD19 CAR, such as a CAR containing an anti-CD19 scFv set forth in SEQ ID NO:363. In some embodiments, the CAR further contains a spacer, a transmembrane domain, and an intracellular signaling domain or region comprising an ITAM signaling domain, such as a CD3zeta signaling domain. In some embodiments, the CAR further includes a costimulatory signaling domain. In some embodiments, the spacer and transmembrane domain are the hinge and transmembrane domain derived from CD8, such as having an exemplary sequence set forth in SEQ ID NO: 332, 364, 1997 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO:332, 364, 1997. In some embodiments, the endodomain comprises at CD3-zeta signaling domain. In some embodiments, the CD3-zeta signaling domain comprises the sequence of amino acids set forth in SEQ ID NO: 333 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO:333 and retains the activity of T cell signaling. In some embodiments, the endodomain of a CAR can further comprise a costimulatory signaling domain or region to further modulate immunomodulatory responses of the T-cell. In some embodiments, the costimulatory signaling domain is or comprises a costimulatory region, or is derived from a costimulatory region, of CD28, ICOS, 41BB or OX40. In some embodiments, the costimulatory signaling domain is a derived from CD28 or 4-1BB and comprises the sequence of amino acids set forth in any of SEQ ID NOS: 365-368 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO:365-368 and retains the activity of T cell costimulatory signaling.

In some embodiments, the construct encoding the CAR further encodes a second protein, such as a marker, e.g., detectable protein, separated from the CAR by a self-cleaving peptide sequence. In some embodiments, the self-cleaving peptide sequence is an F2A, T2A, E2A or P2A self-cleaving peptide. Exemplary sequences of a T2A self-cleaving peptide are set for the in any one of SEQ ID NOS: 369, 2004, 2008 or a sequence of amino acids that exhibits at least 85%, 86%, 87%, 88%, 89%, 90%, 91%, 92%, 93%, 94%, 95%, 96%, 97%, 98% or 99% or more sequence identity to any of SEQ ID NOS: 369, 2004, 2008. In some embodiments, the T2A is encoded by the sequence of nucleotides set forth in SEQ ID NO:2008 or a sequence that exhibits at least 85%, 86%, 87%, 88%, 89%, 90%, 91%, 92%, 93%, 94%, 95%, 96%, 97%, 98% or 99% or more sequence identity to any of SEQ ID NO: 2008. An exemplary sequence of a P2A self-cleaving peptide is set in SEQ ID NO: 2038 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NOS: 3032. In some cases, a nucleic acid construct that encodes more than one P2A self-cleaving peptide (such as a P2A1 and P2A2), in which the nucleotide sequence P2A1 and P2A2 each encode the P2A set forth in SEQ ID NO:3032, the nucleotide sequence may be different to avoid recombination between sequences.

In some embodiments, the marker is a detectable protein, such as a fluorescent protein, e.g., a green fluorescent protein (GFP) or blue fluorescent protein (BFP). Exemplary sequences of a fluorescent protein marker are set forth in SEQ ID NO: 370, 2003, 3033-3035, or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO: 370, 2003, 3033-3035.

In some embodiments, the CAR has the sequence of amino acids set forth in any of SEQ ID NOS: 360, 371, 372, 373, 1998, 1999, 2001, 2002 or a sequence of amino acids that exhibits at least 85%, 86%, 87%, 88%, 89%, 90%, 91%, 92%, 93%, 94%, 95%, 96%, 97%, 98% or 99% or more sequence identity to any one of SEQ ID NOS: 360, 371, 372, 373, 1998, 1999, 2001, 2002. In some embodiments, the CAR is encoded by a sequence of nucleotides set forth in SEQ ID NO: 2000 or 2006 or a sequence of amino acids that exhibits at least 85%, 86%, 87%, 88%, 89%, 90%, 91%, 92%, 93%, 94%, 95%, 96%, 97%, 98% or 99% or more sequence identity to any one of SEQ ID NO: 2000 or 2006.

In another embodiment, the engineered T-cell possesses a TCR, including a recombinant or engineered TCR. In some embodiments, the TCR can be a native TCR. Those of skill in the art will recognize that generally native mammalian T-cell receptors comprise an alpha and a beta chain (or a gamma and a delta chain) involved in antigen specific recognition and binding. In some embodiments, the TCR is an engineered TCR that is modified. In some embodiments, the TCR of an engineered T-cell specifically binds to a tumor associated or tumor specific antigen presented by an APC.

In some embodiments, the immunomodulatory polypeptides, such as transmembrane immunomodulatory polypeptides or secretable immunomodulatory polypeptides, can be incorporated into engineered cells, such as engineered T cells or engineered APCs, by a variety of strategies such as those employed for recombinant host cells. A variety of methods to introduce a DNA construct into primary T cells are known in the art. In some embodiments, viral transduction or plasmid electroporation are employed. In typical embodiments, the nucleic acid molecule encoding the immunomodulatory protein, or the expression vector, comprises a signal peptide that localizes the expressed transmembrane immunomodulatory proteins to the cellular membrane or for secretion. In some embodiments, a nucleic acid encoding a transmembrane immunomodulatory protein of the invention is sub-cloned into a viral vector, such as a retroviral vector, which allows expression in the host mammalian cell. The expression vector can be introduced into a mammalian host cell and, under host cell culture conditions, the immunomodulatory protein is expressed on the surface or is secreted.

In an exemplary example, primary T-cells can be purified ex vivo (CD4 cells or CD8 cells or both) and stimulated with an activation protocol consisting of various TCR/CD28 agonists, such as anti-CD3/anti-CD28 coated beads. After a 2 or 3 day activation process, a recombinant expression vector containing an immunomodulatory polypeptide can be stably introduced into the primary T cells through art standard lentiviral or retroviral transduction protocols or plasmid electroporation strategies. Cells can be monitored for immunomodulatory polypeptide expression by, for example, flow cytometry using anti-epitope tag or antibodies that cross-react with native parental molecule and polypeptides comprising variant CD80. T-cells that express the immunomodulatory polypeptide can be enriched through sorting with anti-epitope tag antibodies or enriched for high or low expression depending on the application.

Upon immunomodulatory polypeptide expression the engineered T-cell can be assayed for appropriate function by a variety of means. The engineered CAR or TCR co-expression can be validated to show that this part of the engineered T cell was not significantly impacted by the expression of the immunomodulatory protein. Once validated, standard in vitro cytotoxicity, proliferation, or cytokine assays (e.g., IFN-gamma expression) can be used to assess the function of engineered T-cells. Exemplary standard endpoints are percent lysis of the tumor line, proliferation of the engineered T-cell, or IFN-gamma protein expression in culture supernatants. An engineered construct which results in statistically significant increased lysis of tumor line, increased proliferation of the engineered T-cell, or increased IFN-gamma expression over the control construct can be selected for. Additionally, non-engineered, such as native primary or endogenous T-cells could also be incorporated into the same in vitro assay to measure the ability of the immunomodulatory polypeptide construct expressed on the engineered cells, such as engineered T-cells, to modulate activity, including, in some cases, to activate and generate effector function in bystander, native T-cells. Increased expression of activation markers such as CD69, CD44, or CD62L could be monitored on endogenous T cells, and increased proliferation and/or cytokine production could indicate desired activity of the immunomodulatory protein expressed on the engineered T cells.

In some embodiments, the similar assays can be used to compare the function of engineered T cells containing the CAR or TCR alone to those containing the CAR or TCR and a TIP construct. Typically, these in vitro assays are performed by plating various ratios of the engineered T cell and a "tumor" cell line containing the cognate CAR or TCR antigen together in culture. Standard endpoints are percent lysis of the tumor line, proliferation of the engineered T cell, or IFN-gamma production in culture supernatants. An engineered immunomodulatory protein which resulted in statistically significant increased lysis of tumor line, increased proliferation of the engineered T cell, or increased IFN-gamma production over the same TCR or CAR construct alone can be selected for. Engineered human T cells can be analyzed in immunocompromised mice, like the NSG strain, which lacks mouse T, NK and B cells. Engineered human T cells in which the CAR or TCR binds a target counter-structure on the xenograft and is co-expressed with the TIP affinity modified IgSF domain can be adoptively transferred in vivo at different cell numbers and ratios compared to the xenograft. For example, engraftment of CD19+ leukemia tumor lines containing a luciferase/GFP vector can be monitored through bioluminescence or ex vivo by flow cytometry. In a common embodiment, the xenograft is introduced into the murine model, followed by the engineered T cells several days later. Engineered T cells containing the immunomodulatory protein can be assayed for increased survival, tumor clearance, or expanded engineered T cells numbers relative to engineered T cells containing the CAR or TCR alone. As in the in vitro assay, endogenous, native (i.e., non-engineered) human T cells could be co-adoptively transferred to look for successful epitope spreading in that population, resulting in better survival or tumor clearance.

E. Infectious Agents Expressing Variant Polypeptides and Immunomodulatory Proteins Also provided are infectious agents that contain nucleic acids encoding any of the variant polypeptides, such as CD80 vIgD polypeptides, including secretable or transmembrane immunomodulatory proteins described herein. In some embodiments, such infectious agents can deliver the nucleic acids encoding the variant immunomodulatory polypeptides described herein, such as CD80 vIgD polypeptides, to a target cell in a subject, e.g., immune cell and/or antigen-presenting cell (APC) or tumor cell in a subject. Also provided are nucleic acids contained in such infectious agents, and/or nucleic acids for generation or modification of such infectious agents, such as vectors and/or plasmids, and compositions containing such infectious agents.

In some embodiments, the infectious agent is a microorganism or a microbe. In some embodiments, the infectious agent is a virus or a bacterium. In some embodiments, the infectious agent is a virus. In some embodiments, the infectious agent is a bacterium. In some embodiments, such infectious agents can deliver nucleic acid sequences encoding any of the variant polypeptides, such as CD80 vIgD polypeptides, including secretable or transmembrane immunomodulatory proteins, described herein. Thus, in some embodiments, the cell in a subject that is infected or contacted by the infectious agents can be rendered to express on the cell surface or secrete, the variant immunomodulatory polypeptides. In some embodiments, the infectious agent can also deliver one or more other therapeutics or nucleic acids encoding other therapeutics to the cell and/or to an environment within the subject. In some embodiments, other therapeutics that can be delivered by the infectious agents include cytokines or other immunomodulatory molecules.

In some embodiments, the infectious agent, e.g., virus or bacteria, contains nucleic acid sequences that encode any of the variant polypeptides, such as CD80 vIgD polypeptides, including secretable or transmembrane immunomodulatory proteins, described herein, and by virtue of contact and/or infection of a cell in the subject, the cell expresses the variant polypeptides, such as CD80 vIgD polypeptides, including secretable or transmembrane immunomodulatory proteins, encoded by the nucleic acid sequences contained in the infectious agent. In some embodiments, the infectious agent can be administered to the subject. In some embodiments, the infectious agent can be contacted with cells from the subject ex vivo.

In some embodiments, the variant polypeptides, such as CD80 vIgD polypeptides, including transmembrane immunomodulatory proteins, expressed by the cell infected by the infectious agent is a transmembrane protein and is surface expressed. In some embodiments, the variant polypeptides, such as CD80 vIgD polypeptides, including secretable immunomodulatory proteins, expressed by the cell infected by the infectious agent is expressed and secreted from the cell. The transmembrane immunomodulatory protein or secreted immunomodulatory protein can be any described herein.

In some embodiments, the cells in the subject that are targeted by the infectious agent include a tumor cell, an immune cell, and/or an antigen-presenting cell (APC). In some embodiments, the infectious agent targets a cell in the tumor microenvironment (TME). In some embodiments, the infectious agent delivers the nucleic acids encoding the variant polypeptides, such as CD80 vIgD polypeptides, including secretable or transmembrane immunomodulatory proteins, to an appropriate cell (for example, an APC, such as a cell that displays a peptide/MHC complex on its cell surface, such as a dendritic cell) or tissue (e.g., lymphoid tissue) that will induce and/or augment the desired effect, e.g., immunomodulation and/or a specific cell-medicated immune response, e.g., CD4 and/or CD8 T cell response, which CD8 T cell response may include a cytotoxic T cell (CTL) response. In some embodiments, the infectious agent targets an APC, such as a dendritic cell (DC). In some embodiments, the nucleic acid molecule delivered by the infectious agents described herein include appropriate nucleic acid sequences necessary for the expression of the operably linked coding sequences encoding the variant immunomodulatory polypeptides, in a particular target cell, e.g., regulatory elements such as promoters.

In some embodiments, the infectious agent that contains nucleic acid sequences encoding the immunomodulatory polypeptides can also contain nucleic acid sequences that encode one or more additional gene products, e.g., cytokines, prodrug converting enzymes, cytotoxins and/or detectable gene products. For example, in some embodiments, the infectious agent is an oncolytic virus and the virus can include nucleic acid sequences encoding additional therapeutic gene products (see, e.g., Kim et al., (2009) Nat Rev Cancer 9:64-71; Garcia-Aragoncillo et al., (2010) Curr Opin Mol Ther 12:403-411; see U.S. Pat. Nos. 7,588,767, 7,588,771, 7,662,398 and 7,754,221 and U.S. Pat. Publ. Nos. 2007/0202572, 2007/0212727, 2010/0062016, 2009/0098529, 2009/0053244, 2009/0155287, 2009/0117034, 2010/0233078, 2009/0162288, 2010/0196325, 2009/0136917 and 2011/0064650. In some embodiments, the additional gene product can be a therapeutic gene product that can result in death of the target cell (e.g., tumor cell) or gene products that can augment or boost or regulate an immune response (e.g., cytokine). Exemplary gene products also include among an anticancer agent, an anti-metastatic agent, an antiangiogenic agent, an immunomodulatory molecule, an immune checkpoint inhibitor, an antibody, a cytokine, a growth factor, an antigen, a cytotoxic gene product, a pro-apoptotic gene product, an anti-apoptotic gene product, a cell matrix degradative gene, genes for tissue regeneration or reprogramming human somatic cells to pluripotency, and other genes described herein or known to one of skill in the art. In some embodiments, the additional gene product is Granulocyte-macrophage colony-stimulating factor (GM-CSF).

1. Viruses

In some embodiments, the infectious agent is a virus. In some embodiments, the infectious agent is an oncolytic virus, or a virus that targets particular cells, e.g., immune cells. In some embodiments, the infectious agent targets a tumor cell and/or cancer cell in the subject. In some embodiments, the infectious agent targets an immune cell or an antigen-presenting cell (APC).

In some embodiments, the infectious agent is an oncolytic virus. Oncolytic viruses are viruses that accumulate in tumor cells and replicate in tumor cells. By virtue of replication in the cells, and optional delivery of nucleic acids encoding variant immunomodulatory variant CD80 polypeptides or immunomodulatory proteins described herein, tumor cells are lysed, and the tumor shrinks and can be eliminated. Oncolytic viruses can also have a broad host and cell type range. For example, oncolytic viruses can accumulate in immunoprivileged cells or immunoprivileged tissues, including tumors and/or metastases, and also including wounded tissues and cells, thus allowing the delivery and expression of nucleic acids encoding the variant immunomodulatory polypeptides described herein in a broad range of cell types. Oncolytic viruses can also replicate in a tumor cell specific manner, resulting in tumor cell lysis and efficient tumor regression.

Exemplary oncolytic viruses include adenoviruses, adeno-associated viruses, herpes viruses, Herpes Simplex Virus, Reovirus, Newcastle Disease virus, parvovirus, measles virus, vesicular stomatitis virus (VSV), Coxsackie virus and Vaccinia virus. In some embodiments, oncolytic viruses can specifically colonize solid tumors, while not infecting other organs, and can be used as an infectious agent to deliver the nucleic acids encoding the variant immunomodulatory polypeptides described herein to such solid tumors.

Oncolytic viruses for use in delivering the nucleic acids encoding variant CD80 polypeptides or immunomodulatory proteins described herein, can be any of those known to one of skill in the art and include, for example, vesicular stomatitis virus, see, e.g., U.S. Pat. Nos. 7,731,974, 7,153,510, 6,653,103 and U.S. Pat. Pub. Nos. 2010/0178684, 2010/0172877, 2010/0113567, 2007/0098743, 20050260601, 20050220818 and EP Pat. Nos. 1385466, 1606411 and 1520175; herpes simplex virus, see, e.g., U.S. Pat. Nos. 7,897,146, 7,731,952, 7,550,296, 7,537,924, 6,723,316, 6,428,968 and U.S. Pat. Pub. Nos., 2014/0154216, 2011/0177032, 2011/0158948, 2010/0092515, 2009/0274728, 2009/0285860, 2009/0215147, 2009/0010889, 2007/0110720, 2006/0039894, 2004/0009604, 2004/0063094, International Patent Pub. Nos., WO 2007/052029, WO 1999/038955; retroviruses, see, e.g., U.S. Pat. Nos. 6,689,871, 6,635,472, 5,851,529, 5,716,826, 5,716,613 and U.S. Pat. Pub. No. 20110212530; vaccinia viruses, see, e.g., 2016/0339066, and adeno-associated viruses, see, e.g., U.S. Pat. Nos. 8,007,780, 7,968,340, 7,943,374, 7,906,111, 7,927,585, 7,811,814, 7,662,627, 7,241,447, 7,238,526, 7,172,893, 7,033,826, 7,001,765, 6,897,045, and 6,632,670.

Oncolytic viruses also include viruses that have been genetically altered to attenuate their virulence, to improve their safety profile, enhance their tumor specificity, and they have also been equipped with additional genes, for example cytotoxins, cytokines, prodrug converting enzymes to improve the overall efficacy of the viruses (see, e.g., Kim et al., (2009) Nat Rev Cancer 9:64-71; Garcia-Aragoncillo et al., (2010) Curr Opin Mol Ther 12:403-411; see U.S. Pat. Nos. 7,588,767, 7,588,771, 7,662,398 and 7,754,221 and U.S. Pat. Publ. Nos. 2007/0202572, 2007/0212727, 2010/0062016, 2009/0098529, 2009/0053244, 2009/0155287, 2009/0117034, 2010/0233078, 2009/0162288, 2010/0196325, 2009/0136917 and 2011/0064650). In some embodiments, the oncolytic viruses can be those that have been modified so that they selectively replicate in cancerous cells, and, thus, are oncolytic. For example, the oncolytic virus is an adenovirus that has been engineered to have modified tropism for tumor therapy and also as gene therapy vectors. Exemplary of such is ONYX-015, H101 and Ad5ΔCR (Hallden and Portella (2012) Expert Opin Ther Targets, 16:945-58) and TNFerade (McLoughlin et al. (2005) Ann. Surg. Oncol., 12:825-30), or a conditionally replicative adenovirus Oncorine®.

In some embodiments, the infectious agent is a modified herpes simplex virus. In some embodiments, the infectious agent is a modified version of Talimogene laherparepvec (also known as T-Vec, Imlygic or OncoVex GM-CSF), that is modified to contain nucleic acids encoding any of the variant immunomodulatory polypeptides described herein, such as any of the variant CD80 polypeptides or immunomodulatory proteins described herein. In some embodiments, the infectious agent is a modified herpes simplex virus that is described, e.g., in WO 2007/052029, WO 1999/038955, US 2004/0063094, US 2014/0154216, or, variants thereof.

In some embodiments, the infectious agent is a virus that targets a particular type of cells in a subject that is administered the virus, e.g., a virus that targets immune cells or antigen-presenting cells (APCs). Dendritic cells (DCs) are essential APCs for the initiation and control of immune responses. DCs can capture and process antigens, migrate from the periphery to a lymphoid organ, and present the antigens to resting T cells in a major histocompatibility complex (MHC)-restricted fashion. In some embodiments, the infectious agent is a virus that specifically can target DCs to deliver nucleic acids encoding the variant CD80 polypeptides or immunomodulatory proteins for expression in DCs. In some embodiments, the virus is a lentivirus or a variant or derivative thereof, such as an integration-deficient lentiviral vector. In some embodiments, the virus is a lentivirus that is pseudotyped to efficiently bind to and productively infect cells expressing the cell surface marker dendritic cell-specific intercellular adhesion molecule-3-grabbing non-integrin (DC-SIGN), such as DCs. In some embodiments, the virus is a lentivirus pseudotyped with a Sindbis virus E2 glycoprotein or modified form thereof, such as those described in WO 2013/149167. In some embodiments, the virus allows for delivery and expression of a sequence of interest (e.g., a nucleic acid encoding any of the variant CD80 polypeptides or immunomodulatory proteins described herein) to a DC. In some embodiments, the virus includes those described in WO 2008/011636 or US 2011/0064763, Tareen et al. (2014) *Mol. Ther.*, 22:575-587, or variants thereof. Exemplary of a dendritic cell-tropic vector platform is ZVex™.

2. Bacteria

In some embodiments, the infectious agent is a bacterium. For example, in some embodiments, the bacteria can deliver nucleic acids encoding any of the variant immunomodulatory polypeptides described herein, e.g., variant CD80 polypeptide or immunomodulatory protein, to a target cell in the subject, such as a tumor cell, an immune cell, an antigen-presenting cell and/or a phagocytic cell. In some embodiments, the bacterium can be preferentially targeted to a specific environment within a subject, such as a tumor microenvironment (TME), for expression and/or secretion of the variant immunomodulatory polypeptides and/or to target specific cells in the environment for expression of the variant immunomodulatory polypeptides.

In some embodiments, the bacterium delivers the nucleic acids to the cells via bacterial-mediated transfer of plasmid DNA to mammalian cells (also referred to as "bactofection"). For example, in some embodiments, delivery of genetic material is achieved through entry of the entire bacterium into target cells. In some embodiments, spontaneous or induced bacterial lysis can lead to the release of plasmid for subsequent eukaryotic cell expression. In some embodiments, the bacterium can deliver nucleic acids to non-phagocytic mammalian cells (e.g., tumor cells) and/or to phagocytic cells, e.g., certain immune cells and/or APCs. In some embodiments, the nucleic acids delivered by the bacterium can be transferred to the nucleus of the cell in the subject for expression. In some embodiments, the nucleic acids also include appropriate nucleic acid sequences necessary for the expression of the operably linked sequences encoding the variant immunomodulatory polypeptides in a particular host cell, e.g., regulatory elements such as promoters or enhancers. In some embodiments, the infectious agent that is a bacterium can deliver nucleic acids encoding the immunomodulatory proteins in the form of an RNA, such as a pre-made translation-competent RNA delivered to the cytoplasm of the target cell for translation by the target cell's machinery.

In some embodiments, the bacterium can replicate and lyse the target cells, e.g., tumor cells. In some embodiments, the bacterium can contain and/or release nucleic acid sequences and/or gene products in the cytoplasm of the target cells, thereby killing the target cell, e.g., tumor cell. In some embodiments, the infectious agent is bacterium that can replicate specifically in a particular environment in the subject, e.g., tumor microenvironment (TME). For example, in some embodiments, the bacterium can replicate specifically in anaerobic or hypoxic microenvironments. In some embodiments, conditions or factors present in particular environments, e.g., aspartate, serine, citrate, ribose or galactose produced by cells in the TME, can act as chemoattractants to attract the bacterium to the environment. In some embodiments, the bacterium can express and/or secrete the immunomodulatory proteins described herein in the environment, e.g., TME.

In some embodiments, the infectious agent is a bacterium that is a *Listeria* sp., a *Bifidobacterium* sp., an *Escherichia* sp., a *Clostridium* sp., a *Salmonella* sp., a *Shigella* sp., a *Vibrio* sp. or a *Yersinia* sp. In some embodiments, the bacterium is selected from among one or more of *Listeria monocytogenes, Salmonella typhimurium, Salmonella choleraesuis, Escherichia coli, Vibrio cholera, Clostridium perfringens, Clostridium butyricum, Clostridium novyi, Clostridium acetobutylicum, Bifidobacterium infantis, Bifidobacterium longum* and *Bifidobacterium adolescentis*. In some embodiments, the bacterium is an engineered bacterium. In some embodiments, the bacterium is an engineered bacterium such as those described in, e.g., Seow and Wood (2009) *Molecular Therapy* 17(5):767-777; Baban et al. (2010) *Bioengineered Bugs* 1:6, 385-394; Patyar et al. (2010) *J Biomed Sci* 17:21; Tangney et al. (2010) *Bioengineered Bugs* 1:4, 284-287; van Pijkeren et al. (2010) *Hum Gene Ther.* 21(4):405-416; WO 2012/149364; WO 2014/198002; U.S. Pat. Nos. 9,103,831; 9,453,227; US 2014/0186401; US 2004/0146488; US 2011/0293705; US 2015/0359909 and EP 3020816. The bacterium can be modified to deliver nucleic acid sequences encoding any of the variant immunomodulatory polypeptides, conjugates and/or fusions provided herein, and/or to express such variant immunomodulatory polypeptides in the subject.

F. Nucleic Acids, Vectors and Methods for Producing the Polypeptides or Cells Provided herein are isolated or recombinant nucleic acids collectively referred to as "nucleic acids" which encode any of the various provided embodiments of the variant CD80 polypeptides or immunomodulatory polypeptides provided herein. In some embodiments, nucleic acids provided herein, including all described below, are useful in recombinant production (e.g., expression) of variant CD80 polypeptides or immunomodulatory polypeptides provided herein. In some embodiments, nucleic acids provided herein, including all described below, are useful in expression of variant CD80 polypeptides or immunomodulatory polypeptides provided herein in cells, such as in engineered cells, e.g., immune cells, or infectious agent cells. The nucleic acids provided herein can be in the form of RNA or in the form of DNA, and include mRNA, cRNA, recombinant or synthetic RNA and DNA, and cDNA. The nucleic acids provided herein are typically DNA molecules, and usually double-stranded DNA molecules. However, single-stranded DNA, single-stranded RNA, double-stranded RNA, and hybrid DNA/RNA nucleic acids or combinations thereof comprising any of the nucleotide sequences of the invention also are provided.

Also provided herein are recombinant expression vectors and recombinant host cells useful in producing the variant CD80 polypeptides or immunomodulatory polypeptides provided herein.

Also provided herein are engineered cells, such as engineered immune cells, containing any of the provided immunomodulatory polypeptides, such as any of the transmembrane immunomodulatory polypeptides or secretable immunomodulatory polypeptides.

Also provided herein are infectious agents, such as bacterial or viral cells, containing any of the provided immunomodulatory polypeptides, such as any of the transmembrane immunomodulatory polypeptides or secretable immunomodulatory polypeptides.

In any of the above provided embodiments, the nucleic acids encoding the immunomodulatory polypeptides provided herein can be introduced into cells using recombinant DNA and cloning techniques. To do so, a recombinant DNA molecule encoding an immunomodulatory polypeptide is prepared. Methods of preparing such DNA molecules are well known in the art. For instance, sequences coding for the peptides could be excised from DNA using suitable restriction enzymes. Alternatively, the DNA molecule could be synthesized using chemical synthesis techniques, such as the phosphoramidite method. Also, a combination of these techniques could be used. In some instances, a recombinant or synthetic nucleic acid may be generated through polymerase chain reaction (PCR). In some embodiments, a DNA insert can be generated encoding one or more variant CD80 polypeptides containing at least one affinity-modified IgSF domain and, in some embodiments, a signal peptide, a transmembrane domain and/or an endodomain in accord with the provided description. This DNA insert can be cloned into an appropriate transduction/transfection vector as is known to those of skill in the art. Also provided are expression vectors containing the nucleic acid molecules.

In some embodiments, the expression vectors are capable of expressing the immunomodulatory proteins in an appropriate cell under conditions suited to expression of the protein. In some aspects, nucleic acid molecule or an expression vector comprises the DNA molecule that encodes the immunomodulatory protein operatively linked to appropriate expression control sequences. Methods of effecting this operative linking, either before or after the DNA molecule is inserted into the vector, are well known. Expression control sequences include promoters, activators, enhancers, operators, ribosomal binding sites, start signals, stop signals, cap signals, polyadenylation signals, and other signals involved with the control of transcription or translation.

In some embodiments, expression of the immunomodulatory protein is controlled by a promoter or enhancer to control or regulate expression. The promoter is operably linked to the portion of the nucleic acid molecule encoding the variant polypeptide or immunomodulatory protein. In some embodiments, the promotor is a constitutively active promotor (such as a tissue-specific constitutively active promotor or other constitutive promotor). In some embodiments, the promotor is an inducible promotor, which may be responsive to an inducing agent (such as a T cell activation signal).

In some embodiments, a constitutive promoter is operatively linked to the nucleic acid molecule encoding the variant polypeptide or immunomodulatory protein. Exemplary constitutive promoters include the Simian vacuolating virus 40 (SV40) promoter, the cytomegalovirus (CMV) promoter, the ubiquitin C (UbC) promoter, and the EF-1 alpha (EFla) promoter. In some embodiments, the constitutive promoter is tissue specific. For example, in some embodiments, the promoter allows for constitutive expression of the immunomodulatory protein in specific tissues, such as immune cells, lymphocytes, or T cells. Exemplary tissue-specific promoters are described in U.S. Pat. No. 5,998,205, including, for example, a fetoprotein, DF3, tyrosinase, CEA, surfactant protein, and ErbB2 promoters.

In some embodiments, an inducible promoter is operatively linked to the nucleic acid molecule encoding the variant polypeptide or immunomodulatory protein such that expression of the nucleic acid is controllable by controlling the presence or absence of the appropriate inducer of transcription. For example, the promoter can be a regulated promoter and transcription factor expression system, such as the published tetracycline-regulated systems or other regulatable systems (see, e.g., published International PCT Appl. No. WO 01/30843), to allow regulated expression of the encoded polypeptide. An exemplary regulatable promoter system is the Tet-On (and Tet-Off) system available, for example, from Clontech (Palo Alto, Calif.). This promoter system allows the regulated expression of the transgene controlled by tetracycline or tetracycline derivatives, such as doxycycline. Other regulatable promoter systems are known (see e.g., published U.S. Application No. 2002-0168714, entitled "Regulation of Gene Expression Using Single-Chain, Monomeric, Ligand Dependent Polypeptide Switches," which describes gene switches that contain ligand binding domains and transcriptional regulating domains, such as those from hormone receptors).

In some embodiments, the promotor is responsive to an element responsive to T-cell activation signaling. Solely by way of example, in some embodiments, an engineered T cell comprises an expression vector encoding the immunomodulatory protein and a promotor operatively linked to control expression of the immunomodulatory protein. The engineered T cell can be activated, for example by signaling through an engineered T cell receptor (TCR) or a chimeric antigen rector (CAR), and thereby triggering expression and secretion of the immunomodulatory protein through the responsive promotor.

In some embodiments, an inducible promoter is operatively linked to the nucleic acid molecule encoding the immunomodulatory protein such that the immunomodulatory protein is expressed in response to a nuclear factor of activated T-cells (NFAT) or nuclear factor kappa-light-chain enhancer of activated B cells (NF-κB). For example, in some embodiments, the inducible promoter comprises a binding site for NFAT or NF-κB. For example, in some embodiments, the promoter is an NFAT or NF-κB promoter or a functional variant thereof. Thus, in some embodiments, the nucleic acids make it possible to control the expression of immunomodulatory protein while also reducing or eliminating the toxicity of the immunomodulatory protein. In particular, engineered immune cells comprising the nucleic acids of the invention express and secrete the immunomodulatory protein only when the cell (e.g., a T-cell receptor (TCR) or a chimeric antigen receptor (CAR) expressed by the cell) is specifically stimulated by an antigen and/or the cell (e.g., the calcium signaling pathway of the cell) is non-specifically stimulated by, e.g., phorbol myristate acetate (PMA)/Ionomycin. Accordingly, the expression and, in some cases, secretion, of immunomodulatory protein can be controlled to occur only when and where it is needed (e.g., in the presence of an infectious disease-causing agent, cancer, or at a tumor site), which can decrease or avoid undesired immunomodulatory protein interactions.

In some embodiments, the nucleic acid encoding an immunomodulatory protein described herein comprises a suitable nucleotide sequence that encodes a NFAT promoter, NF-κB promoter, or a functional variant thereof "NFAT promoter" as used herein means one or more NFAT responsive elements linked to a minimal promoter. "NF-κB promoter" refers to one or more NF-κB responsive elements linked to a minimal promoter. In some embodiments, the minimal promoter of a gene is a minimal human IL-2 promoter or a CMV promoter. The NFAT responsive elements may comprise, e.g., NFAT1, NFAT2, NFAT3, and/or NFAT4 responsive elements. The NFAT promoter, NF-κB promoter, or a functional variant thereof may comprise any number of binding motifs, e.g., at least two, at least three, at least four, at least five, or at least six, at least seven, at least eight, at least nine, at least ten, at least eleven, or up to twelve binding motifs.

The resulting recombinant expression vector having the DNA molecule thereon is used to transform an appropriate host. This transformation can be performed using methods well known in the art. In some embodiments, a nucleic acid provided herein further comprises nucleotide sequence that encodes a secretory or signal peptide operably linked to the nucleic acid encoding an immunomodulatory polypeptide such that a resultant soluble immunomodulatory polypeptide is recovered from the culture medium, host cell, or host cell periplasm. In other embodiments, the appropriate expression control signals are chosen to allow for membrane expression of an immunomodulatory polypeptide. Furthermore, commercially available kits as well as contract manufacturing companies can also be utilized to make engineered cells or recombinant host cells provided herein.

In some embodiments, the resulting expression vector having the DNA molecule thereon is used to transform, such as transduce, an appropriate cell. The introduction can be performed using methods well known in the art. Exemplary methods include those for transfer of nucleic acids encoding the receptors, including via viral, e.g., retroviral or lentiviral, transduction, transposons, and electroporation. In some embodiments, the expression vector is a viral vector. In some embodiments, the nucleic acid is transferred into cells by lentiviral or retroviral transduction methods.

Any of a large number of publicly available and well-known mammalian host cells, including mammalian T-cells or APCs, can be used in the preparing the polypeptides or engineered cells. The selection of a cell is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all cells can be equally effective for the expression of a particular DNA sequence.

In some embodiments, the host cells can be a variety of eukaryotic cells, such as in yeast cells, or with mammalian cells such as Chinese hamster ovary (CHO) or HEK293 cells. In some embodiments, the host cell is a suspension cell and the polypeptide is engineered or produced in cultured suspension, such as in cultured suspension CHO cells, e.g., CHO—S cells. In some examples, the cell line is a CHO cell line that is deficient in DHFR (DHFR-), such as DG44 and DUXB11. In some embodiments, the cell is deficient in glutamine synthase (GS), e.g., CHO—S cells, CHOK1 SV cells, and CHOZN((R)) GS−/− cells. In some embodiments, the CHO cells, such as suspension CHO cells, may be CHO—S-2H2 cells, CHO—S-clone 14 cells, or ExpiCHO-S cells.

In some embodiments, host cells can also be prokaryotic cells, such as with *E. coli*. The transformed recombinant host is cultured under polypeptide expressing conditions, and then purified to obtain a soluble protein. Recombinant host cells can be cultured under conventional fermentation conditions so that the desired polypeptides are expressed. Such fermentation conditions are well known in the art. Finally, the polypeptides provided herein can be recovered and purified from recombinant cell cultures by any of a number of methods well known in the art, including ammonium sulfate or ethanol precipitation, acid extraction, anion or cation exchange chromatography, phosphocellulose chromatography, hydrophobic interaction chromatography, and affinity chromatography. Protein refolding steps can be used, as desired, in completing configuration of the mature protein. Finally, high performance liquid chromatography (HPLC) can be employed in the final purification steps.

In some embodiments, the cell is an immune cell, such as any described above in connection with preparing engineered cells. In some embodiments, such engineered cells are primary cells. In some embodiments, the engineered cells are autologous to the subject. In some embodiment, the engineered cells are allogeneic to the subject. In some embodiments, the engineered cells are obtained from a subject, such as by leukapheresis, and transformed ex vivo for expression of the immunomodulatory polypeptide, e.g., transmembrane immunomodulatory polypeptide or secretable immunomodulatory polypeptide.

Also provided are nucleic acids encoding any of the variant immunomodulatory polypeptides contained in infectious agents described herein. In some embodiments, the infectious agents deliver the nucleic acids to a cell in the subject, and/or permit expression of the encoded variant polypeptides in the cell. Also provided are nucleic acids that are used to generate, produce or modify such infectious agents. For example, in some embodiments, provided are vectors and/or plasmids that contain nucleic acids encoding the variant immunomodulatory polypeptides, for generation of the infectious agents, delivery to the cells in a subject and/or expression of the variant immunomodulatory polypeptides in the cells in the subject.

In some embodiments, the provided nucleic acids are recombinant viral or bacterial vectors containing nucleic acid sequences encoding the variant immunomodulatory polypeptides. In some embodiments, the recombinant vectors can be used to produce an infectious agent that contains nucleic acid sequences encoding the variant immunomodulatory polypeptides and/or to be delivered to a target cell in the subject for expression by the target cell. In some embodiments, the recombinant vector is an expression vector. In some embodiments, the recombinant vector includes appropriate sequences necessary for generation and/or production of the infectious agent and expression in the target cell.

In some embodiments, the recombinant vector is a plasmid or cosmid. Plasmid or cosmid containing nucleic acid sequences encoding the variant immunomodulatory polypeptides, as described herein, is readily constructed using standard techniques well known in the art. For generation of the infectious agent, the vector or genome can be constructed in a plasmid form that can then be transfected into a packaging or producer cell line or a host bacterium. The recombinant vectors can be generated using any of the recombinant techniques known in the art. In some embodiments, the vectors can include a prokaryotic origin of replication and/or a gene whose expression confers a detectable or selectable marker such as a drug resistance for propagation and/or selection in prokaryotic systems.

In some embodiments, the recombinant vector is a viral vector. Exemplary recombinant viral vectors include a lentiviral vector genome, poxvirus vector genome, vaccinia virus vector genome, adenovirus vector genome, adenovirus-associated virus vector genome, herpes virus vector genome, and alpha virus vector genome. Viral vectors can be live, attenuated, replication conditional or replication deficient, non-pathogenic (defective), replication competent viral vector, and/or is modified to express a heterologous gene product, e.g., the variant immunomodulatory polypeptides provided herein. Vectors for generation of viruses also can be modified to alter attenuation of the virus, which includes any method of increasing or decreasing the transcriptional or translational load.

Exemplary viral vectors that can be used include modified vaccinia virus vectors (see, e.g., Guerra et al., J. Virol. 80:985-98 (2006); Tartaglia et al., AIDS Research and Human Retroviruses 8: 1445-47 (1992); Gheradi et al., J. Gen. Virol. 86:2925-36 (2005); Mayr et al., Infection 3:6-14 (1975); Hu et al., J. Virol. 75: 10300-308 (2001); U.S. Pat. Nos. 5,698,530, 6,998,252, 5,443,964, 7,247,615 and 7,368,116); adenovirus vector or adenovirus-associated virus vectors (see., e.g., Molin et al., J. Virol. 72:8358-61 (1998); Narumi et al., Am J. Respir. Cell Mol. Biol. 19:936-41 (1998); Mercier et al., Proc. Natl. Acad. Sci. USA 101:6188-93 (2004); U.S. Pat. Nos. 6,143,290; 6,596,535; 6,855,317; 6,936,257; 7,125,717; 7,378,087; 7,550,296); retroviral vectors including those based upon murine leukemia virus (MuLV), gibbon ape leukemia virus (GaLV), ecotropic retroviruses, simian immunodeficiency virus (SIV), human immunodeficiency virus (HIV), and combinations (see, e.g., Buchscher et al., J. Virol. 66:2731-39 (1992); Johann et al., J. Virol. 66: 1635-40 (1992); Sommerfelt et al., Virology 176:58-59 (1990); Wilson et al., J. Virol. 63:2374-78 (1989); Miller et al., J. Virol. 65:2220-24 (1991); Miller et al., Mol. Cell Biol. 10:4239 (1990); Kolberg, NIH Res. 4:43 1992; Cometta et al., Hum. Gene Ther. 2:215 (1991)); lentiviral vectors including those based upon Human Immunodeficiency Virus (HIV-1), HIV-2, feline immunodeficiency virus (FIV), equine infectious anemia virus, Simian Immunodeficiency Virus (SIV), and maedi/visna virus (see, e.g., Pfeifer et al., Annu. Rev. Genomics Hum. Genet. 2: 177-211 (2001); Zufferey et al., J. Virol. 72: 9873, 1998; Miyoshi et al., J. Virol. 72:8150, 1998; Philpott and Thrasher, Human Gene Therapy 18:483, 2007; Engelman et al., J. Virol. 69: 2729, 1995; Nightingale et al., Mol. Therapy, 13: 1121, 2006; Brown et al., J. Virol. 73:9011 (1999); WO 2009/076524; WO 2012/141984; WO 2016/011083; McWilliams et al., J. Virol. 77: 11150, 2003; Powell et al., J. Virol. 70:5288, 1996) or any, variants thereof, and/or vectors that can be used to generate any of the viruses described above. In some embodiments, the recombinant vector can include regulatory sequences, such as promoter or enhancer sequences, that can regulate the expression of the viral genome, such as in the case for RNA viruses, in the packaging cell line (see, e.g., U.S. Pat. Nos. 5,385,839 and 5,168,062).

In some embodiments, the recombinant vector is an expression vector, e.g., an expression vector that permits expression of the encoded gene product when delivered into the target cell, e.g., a cell in the subject, e.g., a tumor cell, an immune cell and/or an APC. In some embodiments, the recombinant expression vectors contained in the infectious agent are capable of expressing the immunomodulatory proteins in the target cell in the subject, under conditions suited to expression of the protein.

In some aspects, nucleic acids or an expression vector comprises a nucleic acid sequence that encodes the immunomodulatory protein operatively linked to appropriate expression control sequences. Methods of affecting this operative linking, either before or after the nucleic acid sequence encoding the immunomodulatory protein is inserted into the vector, are well known. Expression control sequences include promoters, activators, enhancers, operators, ribosomal binding sites, start signals, stop signals, cap signals, polyadenylation signals, and other signals involved with the control of transcription or translation. The promoter can be operably linked to the portion of the nucleic acid sequence encoding the immunomodulatory protein. In some embodiments, the promotor is a constitutively active promotor in the target cell (such as a tissue-specific constitutively active promotor or other constitutive promotor). For example, the recombinant expression vector may also include, lymphoid tissue-specific transcriptional regulatory elements (TRE) such as a B lymphocyte, T lymphocyte, or dendritic cell specific TRE. Lymphoid tissue specific TRE are known in the art (see, e.g., Thompson et al., Mol. Cell. Biol. 12:1043-53 (1992); Todd et al., J. Exp. Med. 177: 1663-74 (1993); Penix et al., J. Exp. Med. 178:1483-96 (1993)). In some embodiments, the promotor is an inducible promotor, which may be responsive to an inducing agent (such as a T cell activation signal). In some embodiments, nucleic acids delivered to the target cell in the subject, e.g., tumor cell, immune cell and/or APC, can be operably linked to any of the regulatory elements described above.

In some embodiments, the vector is a bacterial vector, e.g., a bacterial plasmid or cosmid. In some embodiments, the bacterial vector is delivered to the target cell, e.g., tumor cells, immune cells and/or APCs, via bacterial-mediated transfer of plasmid DNA to mammalian cells (also referred to as "bactofection"). In some embodiments, the delivered bacterial vector also contains appropriate expression control sequences for expression in the target cells, such as a promoter sequence and/or enhancer sequences, or any regulatory or control sequences described above. In some embodiments, the bacterial vector contains appropriate expression control sequences for expression and/or secretion of the encoded variant polypeptides in the infectious agent, e.g., the bacterium.

In some embodiments, polypeptides provided herein can also be made by synthetic methods. Solid phase synthesis is the preferred technique of making individual peptides since it is the most cost-effective method of making small peptides. For example, well known solid phase synthesis techniques include the use of protecting groups, linkers, and solid phase supports, as well as specific protection and deprotection reaction conditions, linker cleavage conditions, use of scavengers, and other aspects of solid phase peptide synthesis. Peptides can then be assembled into the polypeptides as provided herein.

IV. Methods of Assessing Activity Immune Modulation of Variant CD80 Polypeptides and Immunomodulatory Proteins In some embodiments, the variant CD80 polypeptides provided herein (full-length and/or specific binding fragments or conjugates, stack constructs or fusion thereof or engineered cells) exhibit immunomodulatory activity to modulate T cell activation. In some embodiments, CD80 polypeptides modulate IFN-gamma expression in a T cell assay relative to a wild-type or unmodified CD80 control. In some cases, modulation of IFN-gamma expression can increase or decrease IFN-gamma expression relative to the control. Assays to determine specific binding and IFN-gamma expression are well-known in the art and include the MLR (mixed lymphocyte reaction) assays measuring interferon-gamma cytokine levels in culture supernatants (Wang et al., Cancer Immunol Res. 2014 September: 2(9):846-56), SEB (staphylococcal enterotoxin B) T cell stimulation assay (Wang et al., Cancer Immunol Res. 2014 September: 2(9): 846-56), and anti-CD3 T cell stimulation assays (Li and Kurlander, J Transl Med. 2010: 8: 104).

In some embodiments, a variant CD80 polypeptide can in some embodiments increase or, in alternative embodiments, decrease IFN-gamma (interferon-gamma) expression in a primary T-cell assay relative to a wild-type CD80 control. In some embodiments, such activity may depend on whether the variant CD80 polypeptide is provided in a form for antagonist activity or in a form for agonist activity. In some embodiments, a variant CD80 polypeptide or immunomodulatory protein is an antagonist of the inhibitory receptor, such as blocks an inhibitory signal in the cell that may occur to decrease response to an activating stimulus, e.g., CD3 and/or CD28 costimulatory signal or a mitogenic signal. Those of skill will recognize that different formats of the primary T-cell assay used to determine an increase or decrease in IFN-gamma expression exist.

In assaying for the ability of a variant CD80 to increase or decrease IFN-gamma expression in a primary T-cell assay, a Mixed Lymphocyte Reaction (MLR) assay can be used. In some embodiments, a variant CD80 polypeptide or immunomodulatory protein provided in antagonist form, such as soluble form, e.g., variant CD80-Fc or secretable immunomodulatory protein, block activity of the CTLA-4 inhibitory receptor or PD-L1 and thereby increase MLR activity in the assay, such as observed by increased production of IFN-gamma in the assay. In some embodiments, a variant CD80 polypeptide or immunomodulatory protein provided in agonist form, such as a localizing vIgD stack or conjugate containing a tumor-localizing moiety or an engineered cell expressing a transmembrane immunomodulatory protein as provided, may stimulate activity of the CTLA-4 inhibitory receptor and thereby decrease MLR activity, such as evidenced by decreased IFN-gamma production. In some embodiments, a variant CD80 polypeptide or immunomodulatory protein provided in agonist form, such as a localizing vIgD stack or conjugate containing a tumor-localizing moiety or an engineered cell expressing a transmembrane immunomodulatory protein as provided, may block activity of the CTLA-4 inhibitory receptor and thereby increase MLR activity, such as increase IFN-gamma production.

Alternatively, in assaying for the ability of a variant CD80 to modulate an increase or decrease IFN-gamma expression in a primary T-cell assay, a co-immobilization assay can be used. In a co-immobilization assay, a TCR signal, provided in some embodiments by anti-CD3 antibody, is used in conjunction with a co-immobilized variant CD80 to determine the ability to increase or decrease IFN-gamma expression relative to a CD80 unmodified or wild-type control. In some embodiments, a variant CD80 polypeptide or immunomodulatory protein, e.g., a co-immobilized variant CD80 (e.g., CD80-Fc), increases IFN-gamma production in a co-immobilization assay.

In some embodiments, in assaying for the ability of a variant CD80 to modulate an increase or decrease IFN-gamma expression a T cell reporter assay can be used. In some embodiments, the T cell is a Jurkat T cell line or is derived from Jurkat T cell lines. In reporter assays, the reporter cell line (e.g., Jurkat reporter cell) also is generated to overexpress an inhibitory receptor that is the cognate binding partner of the variant IgSF domain polypeptide. For example, in the case of a variant CD80, the reporter cell line (e.g., Jurkat reporter cell) is generated to overexpress CTLA-4. In some embodiments, the reporter T cells also contain a reporter construct containing an inducible promoter responsive to T cell activation operably linked to a reporter. In some embodiments, the reporter is a fluorescent or luminescent reporter. In some embodiments, the reporter is luciferase. In some embodiments, the promoter is responsive to CD3 signaling. In some embodiments, the promoter is an NFAT promoter. In some embodiments, the promoter is responsive to costimulatory signaling, e.g., CD28 costimulatory signaling. In some embodiments, the promoter is an IL-2 promoter.

In aspects of a reporter assay, a reporter cell line is stimulated, such as by co-incubation with antigen presenting cells (APCs) expressing the wild-type ligand of the inhibitory receptor, e.g., CD80. In some embodiments, the APCs are artificial APCs. Artificial APCs are well known to a skilled artisan. In some embodiments, artificial APCs are derived from one or more mammalian cell line, such as K562, CHO or 293 cells. In some embodiments, the artificial APCs are engineered to express an anti-CD3 antibody and, in some cases, a costimulatory ligand. In some embodiments, the artificial APC is generated to overexpress the cognate binding partner of the variant IgSF domain polypeptide. For example, in the case of a variant CD80, the reporter cell line (e.g., Jurkat reporter cell) is generated to overexpress the inhibitory ligand PD-L1.

In some embodiments, the Jurkat reporter cells are co-incubated with artificial APCs overexpressing the inhibitory ligand in the presence of the variant IgSF domain molecule or immunomodulatory protein, e.g., variant CD80 polypeptide or immunomodulatory protein. In some embodiments, reporter expression is monitored, such as by determining the luminescence or fluorescence of the cells. In some embodiments, normal interactions between its inhibitory receptor and ligand result in a repression of or decrease in the reporter signal, such as compared to control, e.g., reporter expression by co-incubation of control T cells and APCs in which the inhibitory receptor and ligand interaction is not present, e.g., APCs that do not overexpress CD80. In some embodiments, a variant CD80 polypeptide or immunomodulatory protein provided herein antagonizes the interaction, e.g., when provided in soluble form as a variant CD80-Fc or when expressed from the APC as a secretable immunomodulatory protein, thereby resulting in an increase in the reporter signal compared to the absence of the variant CD80 polypeptide or immunomodulatory protein. In certain embodiments provided herein, a variant CD80 polypeptide or immunomodulatory protein mediates CD28 agonism, such as such as PD-L1-dependent CD28 costimulation, e.g. when provided in soluble form as a variant CD80-Fc, thereby resulting in an increase of the reporter signal compared to the absence of the variant CD80 polypeptide or immunomodulatory protein. In some cases, certain formats of a variant CD80 polypeptide or immunomodulatory protein as provided herein may provide an agonist activity of an inhibitory receptor, thereby decreasing reporter expression compared to the absence of the variant CD80 polypeptide or immunomodulatory protein.

Use of proper controls is known to those of skill in the art, however, in the aforementioned embodiments, a control typically involves use of the unmodified CD80, such as a wild-type of native CD80 isoform from the same mammalian species from which the variant CD80 was derived or developed. In some embodiments, the wild-type or native CD80 is of the same form or corresponding form as the variant. For example, if the variant CD80 is a soluble form containing a variant ECD fused to an Fc protein, then the control is a soluble form containing the wild-type or native ECD of CD80 fused to the Fc protein. Irrespective of whether the binding affinity and/or selectivity to either one or more of CTLA-4 and CD80 is increased or decreased, a variant CD80 in some embodiments will increase IFN-gamma expression and, in alternative embodiments, decrease IFN-gamma expression in a T-cell assay relative to a wild-type CD80 control.

In some embodiments, a variant CD80 polypeptide or immunomodulatory protein, increases IFN-gamma expression (i.e., protein expression) relative to a wild-type or unmodified CD80 control by at least: 5%, 10%, 20%, 30%, 40%, 50%, 60%, 70%, 80%, 90%, or higher. In other embodiments, a variant CD80 or immunomodulatory protein decreases IFN-gamma expression (i.e. protein expression) relative to a wild-type or unmodified CD80 control by at least: 5%, 10%, 20%, 30%, 40%, 50%, 60%, 70%, 80%, 90%, or higher. In some embodiments, the wild-type CD80 control is murine CD80, such as would typically be used for a variant CD80 altered in sequence from that of a wild-type murine CD80 sequence. In some embodiments, the wild-type CD80 control is human CD80, such as would typically be used for a variant CD80 altered in sequence from that of a corresponding wild-type human CD80 sequence such as an CD80 sequence comprising the sequence of amino acids of SEQ ID NO: 1, SEQ ID NO: 2 or SEQ ID NO: 76 or SEQ ID NO:150 or SEQ ID NO: 3030 or SEQ ID NO:3031.

V. Pharmaceutical Formulations

Provided herein are compositions containing any of the variant CD80 polypeptides, immunomodulatory proteins, conjugates, engineered cells or infectious agents described herein. The pharmaceutical composition can further comprise a pharmaceutically acceptable excipient. For example, the pharmaceutical composition can contain one or more excipients for modifying, maintaining or preserving, for example, the pH, osmolarity, viscosity, clarity, color, isotonicity, odor, sterility, stability, rate of dissolution or release, adsorption, or penetration of the composition. In some aspects, a skilled artisan understands that a pharmaceutical composition containing cells may differ from a pharmaceutical composition containing a protein.

In some embodiments, the pharmaceutical composition is a solid, such as a powder, capsule, or tablet. For example, the components of the pharmaceutical composition can be lyophilized. In some embodiments, the solid pharmaceutical composition is reconstituted or dissolved in a liquid prior to administration.

In some embodiments, the pharmaceutical composition is a liquid, for example variant CD80 polypeptides dissolved in an aqueous solution (such as physiological saline or Ringer's solution). In some embodiments, the pH of the pharmaceutical composition is between about 4.0 and about 8.5 (such as between about 4.0 and about 5.0, between about 4.5 and about 5.5, between about 5.0 and about 6.0, between about 5.5 and about 6.5, between about 6.0 and about 7.0, between about 6.5 and about 7.5, between about 7.0 and about 8.0, or between about 7.5 and about 8.5).

In some embodiments, the pharmaceutical composition comprises a pharmaceutically-acceptable excipient, for example a filler, binder, coating, preservative, lubricant, flavoring agent, sweetening agent, coloring agent, a solvent, a buffering agent, a chelating agent, or stabilizer. Examples of pharmaceutically-acceptable fillers include cellulose, dibasic calcium phosphate, calcium carbonate, microcrystalline cellulose, sucrose, lactose, glucose, mannitol, sorbitol, maltol, pregelatinized starch, corn starch, or potato starch. Examples of pharmaceutically-acceptable binders include polyvinylpyrrolidone, starch, lactose, xylitol, sorbitol, maltitol, gelatin, sucrose, polyethylene glycol, methyl cellulose, or cellulose. Examples of pharmaceutically-acceptable coatings include hydroxypropyl methylcellulose (HPMC), shellac, corn protein zein, or gelatin. Examples of pharmaceutically-acceptable disintegrants include polyvinylpyrrolidone, carboxymethyl cellulose, or sodium starch glycolate. Examples of pharmaceutically-acceptable lubricants include polyethylene glycol, magnesium stearate, or stearic acid. Examples of pharmaceutically-acceptable preservatives include methyl parabens, ethyl parabens, propyl paraben, benzoic acid, or sorbic acid. Examples of pharmaceutically-acceptable sweetening agents include sucrose, saccharine, aspartame, or sorbitol. Examples of pharmaceutically-acceptable buffering agents include carbonates, citrates, gluconates, acetates, phosphates, or tartrates.

In some embodiments, the pharmaceutical composition further comprises an agent for the controlled or sustained release of the product, such as injectable microspheres, bio-erodible particles, polymeric compounds (polylactic acid, polyglycolic acid), beads, or liposomes.

In some embodiments, the pharmaceutical composition is sterile. Sterilization may be accomplished by filtration through sterile filtration membranes or radiation. Where the composition is lyophilized, sterilization using this method may be conducted either prior to or following lyophilization and reconstitution. The composition for parenteral administration may be stored in lyophilized form or in solution. In addition, parenteral compositions generally are placed into a container having a sterile access port, for example, an intravenous solution bag or vial having a stopper pierceable by a hypodermic injection needle.

In some embodiments, provided are pharmaceutical compositions containing the transmembrane immunomodulatory proteins, including engineered cells expressing such transmembrane immunomodulatory proteins. In some embodiments, the pharmaceutical compositions and formulations include one or more optional pharmaceutically acceptable carrier or excipient. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are preferably formulated for intravenous administration.

Such a formulation may, for example, be in a form suitable for intravenous infusion. A pharmaceutically acceptable carrier may be a pharmaceutically acceptable material, composition, or vehicle that is involved in carrying or transporting cells of interest from one tissue, organ, or portion of the body to another tissue, organ, or portion of the body. For example, the carrier may be a liquid or solid filler, diluent, excipient, solvent, or encapsulating material, or some combination thereof. Each component of the carrier must be "pharmaceutically acceptable" in that it must be compatible with the other ingredients of the formulation. It also must be suitable for contact with any tissue, organ, or portion of the body that it may encounter, meaning that it must not carry a risk of toxicity, irritation, allergic response, immunogenicity, or any other complication that excessively outweighs its therapeutic benefits.

In some embodiments, the pharmaceutical composition is administered to a subject. Generally, dosages and routes of administration of the pharmaceutical composition are determined according to the size and condition of the subject, according to standard pharmaceutical practice. For example, the therapeutically effective dose can be estimated initially either in cell culture assays or in animal models such as mice, rats, rabbits, dogs, pigs, or monkeys. An animal model may also be used to determine the appropriate concentration range and route of administration. Such information can then be used to determine useful doses and routes for administration in humans. The exact dosage will be determined in light of factors related to the subject requiring treatment. Dosage and administration are adjusted to provide sufficient levels of the active compound or to maintain the desired effect. Factors that may be taken into account include the severity of the disease state, the general health of the subject, the age, weight, and gender of the subject, time and frequency of administration, drug combination(s), reaction sensitivities, and response to therapy.

Long-acting pharmaceutical compositions may be administered every 3 to 4 days, every week, or biweekly depending on the half-life and clearance rate of the particular formulation. The frequency of dosing will depend upon the pharmacokinetic parameters of the molecule in the formulation used. Typically, a composition is administered until a dosage is reached that achieves the desired effect. The composition may therefore be administered as a single dose, or as multiple doses (at the same or different concentrations/dosages) over time, or as a continuous infusion. Further refinement of the appropriate dosage is routinely made. Appropriate dosages may be ascertained through use of appropriate dose-response data. A number of biomarkers or physiological markers for therapeutic effect can be monitored including T cell activation or proliferation, cytokine synthesis or production (e.g., production of TNF-α, IFN-γ, IL-2), induction of various activation markers (e.g., CD25, IL-2 receptor), inflammation, joint swelling or tenderness, serum level of C-reactive protein, anti-collagen antibody production, and/or T cell-dependent antibody response(s).

In some embodiments, the pharmaceutical composition is administered to a subject through any route, including orally, transdermally, by inhalation, intravenously, intra-arterially, intramuscularly, direct application to a wound site, application to a surgical site, intraperitoneally, by suppository, subcutaneously, intradermally, transcutaneously, by nebulization, intrapleurally, intraventricularly, intra-articularly, intraocularly, or intraspinally.

In some embodiments, the dosage of the pharmaceutical composition is a single dose or a repeated dose. In some embodiments, the doses are given to a subject once per day, twice per day, three times per day, or four or more times per day. In some embodiments, about 1 or more (such as about 2 or more, about 3 or more, about 4 or more, about 5 or more, about 6 or more, or about 7 or more) doses are given in a week. In some embodiments, multiple doses are given over the course of days, weeks, months, or years. In some embodiments, a course of treatment is about 1 or more doses (such as about 2 or more does, about 3 or more doses, about 4 or more doses, about 5 or more doses, about 7 or more doses, about 10 or more doses, about 15 or more doses, about 25 or more doses, about 40 or more doses, about 50 or more doses, or about 100 or more doses).

In some embodiments, an administered dose of the pharmaceutical composition is about 1 μg of protein per kg subject body mass or more (such as about 2 μg of protein per kg subject body mass or more, about 5 μg of protein per kg subject body mass or more, about 10 μg of protein per kg subject body mass or more, about 25 μg of protein per kg subject body mass or more, about 50 μg of protein per kg subject body mass or more, about 100 μg of protein per kg subject body mass or more, about 250 μg of protein per kg subject body mass or more, about 500 μg of protein per kg subject body mass or more, about 1 mg of protein per kg subject body mass or more, about 2 mg of protein per kg subject body mass or more, or about 5 mg of protein per kg subject body mass or more).

In some embodiments, a therapeutic amount of a cell composition is administered. Typically, precise amount of the compositions of the present invention to be administered can be determined by a physician with consideration of individual differences in age, weight, tumor size, extent of infection or metastasis, and condition of the patient (subject). It can generally be stated that a pharmaceutical composition comprising engineered cells, e.g., T cells, as described herein may be administered at a dosage of 104 to $10^9$ cells/kg body weight, such as 105 to $10^6$ cells/kg body weight, including all integer values within those ranges. Engineered cell compositions, such as T cell compositions, may also be administered multiple times at these dosages. The cells can be administered by using infusion techniques that are commonly known in immunotherapy (see, e.g., Rosenberg et al, New Eng. J. of Med. 319: 1676, 1988). The optimal dosage and treatment regime for a particular patient can readily be determined by one skilled in the art of medicine by monitoring the patient for signs of disease and adjusting the treatment accordingly.

In some embodiments, the pharmaceutical composition contains infectious agents containing nucleic acid sequences encoding the immunomodulatory variant polypeptides. In some embodiments, the pharmaceutical composition contains a dose of infectious agents suitable for administration to a subject that is suitable for treatment. In some embodiments, the pharmaceutical composition contains an infectious agent that is a virus, at a single or multiple dosage amount, of between about between or between about $1\times10^5$ and about $1\times10^{12}$ plaque-forming units (pfu), $1\times10^6$ and $1\times10^{10}$ pfu, or $1\times10^7$ and $1\times10^{10}$ pfu, each inclusive, such as at least or at least about or at about $1\times10^6$, $1\times10^7$, $1\times10^8$, $1\times10^9$, $2\times10^9$, $3\times10^9$, $4\times10^9$, $5\times10^9$ pfu or about $1\times10^{10}$ pfu. In some embodiments, the pharmaceutical composition can contain a virus concentration of from or from about $10^5$ to about $10^{10}$ pfu/mL, for example, $5\times10^6$ to $5\times10^9$ or $1\times10^7$ to $1\times10^9$ pfu/mL, such as at least or at least about or at about $10^6$ pfu/mL, $10^7$ pfu/mL, $10^8$ pfu/mL or $10^9$ pfu/mL. In some embodiments, the pharmaceutical composition contains an infectious agent that is a bacterium, at a single or multiple dosage amount, of between about between or between about $1\times10^3$ and about $1\times10^9$ colony-forming units (cfu), $1\times10^4$ and $1\times10^9$ cfu, or $1\times10^5$ and $1\times10^7$ cfu, each inclusive, such as at least or at least about or at about $1\times10^4$, $1\times10^5$, $1\times10^6$, $1\times10^7$, $1\times10^8$ or $1\times10^9$ cfu. In some embodiments, the pharmaceutical composition can contain a bacterial concentration of from or from about $10^3$ to about $10^8$ cfu/mL, for example, $5\times10^5$ to $5\times10^7$ or $1\times10^6$ to $1\times10^7$ cfu/mL, such as at least or at least about or at about $10^5$ cfu/mL, $10^6$ cfu/mL, $10^7$ cfu/mL or $10^8$ cfu/mL.

A variety of means are known for determining if administration of a therapeutic composition of the invention sufficiently modulates immunological activity by eliminating, sequestering, or inactivating immune cells mediating or capable of mediating an undesired immune response; inducing, generating, or turning on immune cells that mediate or are capable of mediating a protective immune response; changing the physical or functional properties of immune cells; or a combination of these effects. Examples of measurements of the modulation of immunological activity include, but are not limited to, examination of the presence or absence of immune cell populations (using flow cytometry, immunohistochemistry, histology, electron microscopy, polymerase chain reaction (PCR)); measurement of the functional capacity of immune cells including ability or resistance to proliferate or divide in response to a signal (such as using T-cell proliferation assays and pepscan analysis based on 3H-thymidine incorporation following stimulation with anti-CD3 antibody, anti-T-cell receptor antibody, anti-CD28 antibody, calcium ionophores, PMA (phorbol 12-myristate 13-acetate) antigen presenting cells loaded with a peptide or protein antigen; B cell proliferation assays); measurement of the ability to kill or lyse other cells (such as cytotoxic T cell assays); measurements of the cytokines, chemokines, cell surface molecules, antibodies and other products of the cells (e.g., by flow cytometry, enzyme-linked immunosorbent assays, Western blot analysis, protein microarray analysis, immunoprecipitation analysis); measurement of biochemical markers of activation of immune cells or signaling pathways within immune cells (e.g., Western blot and immunoprecipitation analysis of tyrosine, serine or threonine phosphorylation, polypeptide cleavage, and formation or dissociation of protein complexes; protein array analysis; DNA transcriptional, profiling using DNA arrays or subtractive hybridization); measurements of cell death by apoptosis, necrosis, or other mechanisms (e.g., annexin V staining, TUNEL assays, gel electrophoresis to measure DNA laddering, histology; fluorogenic caspase assays, Western blot analysis of caspase substrates); measurement of the genes, proteins, and other molecules produced by immune cells (e.g., Northern blot analysis, polymerase chain reaction, DNA microarrays, protein microarrays, 2-dimensional gel electrophoresis, Western blot analysis, enzyme linked immunosorbent assays, flow cytometry); and measurement of clinical symptoms or outcomes such as improvement of autoimmune, neurodegenerative, and other diseases involving self-proteins or self-polypeptides (clinical scores, requirements for use of additional therapies, functional status, imaging studies) for example, by measuring relapse rate or disease severity (using clinical scores known to the ordinarily skilled artisan) in the case of multiple sclerosis, measuring blood glucose in the case of type I diabetes, or joint inflammation in the case of rheumatoid arthritis.

VI. Articles of Manufacture and Kits

Also provided herein are articles of manufacture that comprise the pharmaceutical compositions described herein in suitable packaging. Suitable packaging for compositions (such as ophthalmic compositions) described herein are known in the art, and include, for example, vials (such as sealed vials), vessels, ampules, bottles, jars, flexible packaging (e.g., sealed Mylar or plastic bags), and the like. These articles of manufacture may further be sterilized and/or sealed.

Further provided are kits comprising the pharmaceutical compositions (or articles of manufacture) described herein, which may further comprise instruction(s) on methods of using the composition, such as uses described herein. The kits described herein may also include other materials desirable from a commercial and user standpoint, including other buffers, diluents, filters, needles, syringes, and package inserts with instructions for performing any methods described herein.

VII. Therapeutic Applications

Provided herein are methods using the provided pharmaceutical compositions containing a variant CD80 polypeptides immunomodulatory protein, engineered cell or infectious agent described herein, for modulating an immune response, including in connection with treating a disease or condition in a subject, such as in a human patient. The pharmaceutical compositions described herein (including pharmaceutical composition comprising the variant CD80 polypeptides, the immunomodulatory proteins, the conjugates, and the engineered cells described herein) can be used in a variety of therapeutic applications, such as the treatment of a disease. For example, in some embodiments the pharmaceutical composition is used to treat inflammatory or autoimmune disorders, cancer, organ transplantation, viral infections, and/or bacterial infections in a mammal. The pharmaceutical composition can modulate (e.g., increase or decrease) an immune response to treat the disease. In some embodiments, the methods are carried out with variant CD80 polypeptides in a format to increase an immune response in a subject. In some such aspects, increasing an immune response treats a disease or condition in the subject, such as a tumor or cancer. In some embodiments, the methods are carried out with variant CD80 polypeptides in a format to decrease an immune response in a subject. In some such aspects, decreasing an immune response treats a disease or condition in a subject, such as an inflammatory disease or condition, e.g. an autoimmune disease.

In some embodiments, the provided methods are applicable to therapeutic administration of variant CD80 polypeptides, the immunomodulatory proteins, the conjugates, the engineered cells and infectious agents described herein. It is within the level of a skilled artisan, in view of the provided disclosure, to choose a format for the indication depending on the type of modulation of the immune response, e.g., increase or decrease that is desired.

In some embodiments, a pharmaceutical composition provided herein that stimulates or increases the immune response is administered, which can be useful, for example, in the treatment of cancer, viral infections, or bacterial infections. Among the provided methods are methods involving delivery of variant CD80 polypeptides, such as in soluble formats, with increased affinity for CTLA-4 and/or PD-L1, which can antagonize signaling of an inhibitory receptor, such as block an inhibitory signal in the cell that may occur to decrease response to an activating stimulus, e.g., CD3 and/or CD28 costimulatory signal or a mitogenic signal. In some cases, the result of this can be to increase the immune response. In some embodiments, antagonism of CTLA-4 or PD-L1/PD-1 may be useful to promote immunity in oncology, such as for treatment of tumors or cancers. In some embodiments, agonism of CD28, which can be dependent on or enhanced by CD80 co-binding PD-L1, may be useful to promote immunity in oncology, such as for treatment of tumors or cancers.

There is provided methods of increasing an immune response by delivery of a variant CD80 polypeptide that binds to CTLA-4, such as binds CTLA-4 with increased affinity compared to a wildtype CD80 polypeptide. In some embodiments, the pharmaceutical composition contains a variant CD80 polypeptide in a format that exhibits antagonist activity of its cognate binding partner CTLA-4 and/or that inhibits signaling via CTLA-4. Exemplary formats of CD80 polypeptide for use in connection with such therapeutic applications include, for example, a variant CD80 polypeptide that is soluble (e.g., variant CD80-Fc fusion protein), an immunomodulatory protein or "stack" of a variant CD80 polypeptide and another IgSF domain, including soluble forms thereof that are Fc fusions, an engineered cell expressing a secretable immunomodulatory protein, or an infectious agent comprising a nucleic acid molecule encoding a secretable immunomodulatory protein, such as for expression and secretion of the secretable immunomodulatory protein in an infected cell (e.g., tumor cell or APC, e.g., dendritic cell). Among such methods are methods carried out by delivery of a variant CD80 polypeptide in a soluble format, which can antagonize signaling of the CTLA-4 inhibitory receptor by binding the CTLA-4 inhibitory receptor, blocking its interaction with CD80 or CD86, expressed on an APC, thereby preventing the negative regulatory signaling of the CD80/CD86-bound CTLA-4 receptor. In some cases, the result of this can be to increase the immune response, which, in some aspects, can treat a disease or condition in the subject, such as treatment of a tumor or cancer. Exemplary soluble formats include any as described. Included among such therapeutic agents are formats in which an extracellular portion of a CD80 variant polypeptide containing an affinity modified IgSF domain (e.g. IgV) is linked, directly or indirectly, to a multimerization domain, e.g. an Fc domain or region. In some embodiments, such a therapeutic agent is a variant CD80-Fc fusion protein.

There is provided methods of increasing an immune response by delivery of a variant CD80 polypeptide that binds to PD-L1, such as binds PD-L1 with increased affinity compared to an unmodified or wildtype CD80 polypeptide. In some embodiments, the provided CD80 polypeptides, e.g., soluble forms of the variant CD80 polypeptides provided herein, are capable of binding the PD-L1 on a tumor cell or APC, thereby blocking the interaction of PD-L1 and the PD-1 inhibitory receptor to prevent the negative regulatory signaling that would have otherwise resulted from the PD-L1/PD-1 interaction. In some cases, the result of this can be to increase the immune response, which, in some aspects, can treat a disease or condition in the subject, such as treatment of a tumor or cancer. Exemplary soluble formats include any as described. Included among such therapeutic agents are formats in which an extracellular portion of a CD80 variant polypeptide containing an affinity modified IgSF domain (e.g. IgV) is linked, directly or indirectly, to a multimerization domain, e.g. an Fc domain or region. In some embodiments, such a therapeutic agent is a variant CD80-Fc fusion protein.

Also among provided embodiments are methods for mediating agonism of CD28 by PD-L1 dependent CD28 costimulation using variant CD80 polypeptides that exhibit increased binding to PD-L1 compared to unmodified or wild-type CD80 polypeptide. In some aspects, such methods can be used to increase an immune response in a subject administered the molecules, which, in some aspects, can treat a disease or condition in the subject, such as treatment of a tumor or cancer. Among such methods are methods carried out by delivery of a variant CD80 polypeptide in a soluble format. Exemplary soluble formats are described herein, including formats in which an extracellular portion of a CD80 variant polypeptide containing an affinity modified IgSF domain (e.g. IgV) is linked, directly or indirectly, to a multimerization domain, e.g. an Fc domain or region. In some embodiments, such a therapeutic agent is a variant CD80-Fc fusion protein. Such PD-L1-dependent costimulation does not require an Fc with effector function and can be mediated by an Fc fusion protein containing an effector-less or inert Fc molecule. In some cases, such variant CD80 polypeptides, e.g. soluble forms, also can facilitate promotion of an immune response in connection with the provided therapeutic methods by blocking the PD-L1/PD-1 interaction while also binding and co-stimulating a CD28 receptor on a localized T cell.

In some embodiments, a variant CD80 polypeptide that is linked, directly or indirectly to an Fc that retains or exhibits effector function is administered to a subject to mediate CD28 agonism. There is provided methods for mediating agonism of CD28 by receptor-dependent CD28 costimulation using variant CD80 polypeptides provided herein the bind to CD28. In some embodiments, such agonism of CD28 may be useful to promote immunity in oncology, such as for treatment of tumors or cancer. In some cases, the variant CD80 polypeptides also bind CTLA-4 or PD-L1, such as exhibit increased binding to CTLA-4 or PD-L1. In some aspects, crosslinking the Fc receptor can initiate antibody-dependent cell cytotoxicity (ADCC)-mediated effector functions, and thereby effect depletion of target cells expressing the cognate binding partner, such as CTLA-4-expressing cells (e.g. CTLA-4-expressing T regulatory cells) or PD-L1-expressing cells (e.g. PD-L1$^{hi}$ tumors). The provided methods to modulate an immune response can be used to treat a disease or condition, such as a tumor or cancer. In some embodiments, the pharmaceutical composition can be used to inhibit growth of mammalian cancer cells (such as human cancer cells). A method of treating cancer can include administering an effective amount of any of the pharmaceutical compositions described herein to a subject with cancer. The effective amount of the pharmaceutical composition can be administered to inhibit, halt, or reverse progression of cancers. Human cancer cells can be treated in vivo, or ex vivo. In ex vivo treatment of a human patient, tissue or fluids containing cancer cells are treated outside the body and then the tissue or fluids are reintroduced back into the patient. In some embodiments, the cancer is treated in a human patient in vivo by administration of the therapeutic composition into the patient. Thus, the present invention provides ex vivo and in vivo methods to inhibit, halt, or reverse progression of the tumor, or otherwise result in a statistically significant increase in progression-free survival (i.e., the length of time during and after treatment in which a patient is living with cancer that does not get worse), or overall survival (also called "survival rate;" i.e., the percentage of people in a study or treatment group who are alive for a certain period of time after they were diagnosed with or treated for cancer) relative to treatment with a control.

The cancers that can be treated by the pharmaceutical compositions and the treatment methods described herein include, but are not limited to, melanoma, bladder cancer, hematological malignancies (leukemia, lymphoma, myeloma), liver cancer, brain cancer, renal cancer, breast cancer, pancreatic cancer (adenocarcinoma), colorectal cancer, lung cancer (small cell lung cancer and non-small-cell lung cancer), spleen cancer, cancer of the thymus or blood cells (i.e., leukemia), prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer. In some embodiments, the cancer is Ewing's sarcoma. In some embodiments, the cancer is selected from melanoma, lung cancer, bladder cancer, and a hematological malignancy. In some embodiments, the cancer is a lymphoma, lymphoid leukemia, myeloid leukemia, cervical cancer, neuroblastoma, or multiple myeloma.

In some embodiments, the pharmaceutical composition is administered as a monotherapy (i.e., as a single agent) or as a combination therapy (i.e., in combination with one or more additional anticancer agents, such as a chemotherapeutic drug, a cancer vaccine, or an immune checkpoint inhibitor. In some embodiments, the pharmaceutical composition can also be administered with radiation therapy. In some aspects of the present disclosure, the immune checkpoint inhibitor is nivolumab, Tremelimumab, pembrolizumab, ipilimumab, or the like.

In some embodiments, the pharmaceutical composition suppresses an immune response, which can be useful in the treatment of inflammatory or autoimmune disorders, or organ transplantation. In some embodiments, the pharmaceutical composition contains a variant CD80 polypeptide in a format that exhibits agonist activity of its cognate binding partner CTLA-4 and/or that stimulates inhibitory signaling via CTLA-4. Exemplary formats of a CD80 polypeptide for use in connection with such therapeutic applications include, for example, an immunomodulatory protein or "stack" of a variant CD80 polypeptide and an IgSF domain or variant thereof that localizes to a cell or tissue of an inflammatory environment, a conjugate containing a variant CD80 polypeptide linked to a moiety that localizes to a cell or tissue of an inflammatory environment, an engineered cell expressing a transmembrane immunomodulatory protein, or an infectious agent comprising a nucleic acid molecule encoding a transmembrane immunomodulatory protein, such as for expression of the transmembrane immunomodulatory protein in an infected cell.

In some embodiments, the inflammatory or autoimmune disorder is antineutrophil cytoplasmic antibodies (ANCA)-associated vasculitis, a vasculitis, an autoimmune skin disease, transplantation, a Rheumatic disease, an inflammatory gastrointestinal disease, an inflammatory eye disease, an inflammatory neurological disease, an inflammatory pulmonary disease, an inflammatory endocrine disease, or an autoimmune hematological disease.

In some embodiments, the inflammatory and autoimmune disorders that can be treated by the pharmaceutical composition described herein is Addison's Disease, allergies, alopecia areata, Alzheimer's, anti-neutrophil cytoplasmic antibodies (ANCA)-associated vasculitis, ankylosing spondylitis, antiphospholipid syndrome (Hughes Syndrome), asthma, atherosclerosis, rheumatoid arthritis, autoimmune hemolytic anemia, autoimmune hepatitis, autoimmune inner ear disease, autoimmune lymphoproliferative syndrome, autoimmune myocarditis, autoimmune oophoritis, autoimmune orchitis, azoospermia, Behcet's Disease, Berger's Disease, bullous pemphigoid, cardiomyopathy, cardiovascular disease, celiac Sprue/coeliac disease, chronic fatigue immune dysfunction syndrome (CFIDS), chronic idiopathic polyneuritis, chronic inflammatory demyelinating, polyradicalneuropathy (CIDP), chronic relapsing polyneuropathy (Guillain-Barre syndrome), Churg-Strauss Syndrome (CSS), cicatricial pemphigoid, cold agglutinin disease (CAD), COPD (chronic obstructive pulmonary disease), CREST syndrome, Crohn's disease, dermatitis, herpetiformus, dermatomyositis, diabetes, discoid lupus, eczema, epidermolysis bullosa acquisita, essential mixed cryoglobulinemia, Evan's Syndrome, exopthalmos, fibromyalgia, Goodpasture's Syndrome, Graves' Disease, Hashimoto's thyroiditis, idiopathic pulmonary fibrosis, idiopathic thrombocytopenia purpura (ITP), IgA nephropathy, immunoproliferative disease or disorder, inflammatory bowel disease (IBD), interstitial lung disease, juvenile arthritis, juvenile idiopathic arthritis (JIA), Kawasaki's Disease, Lambert-Eaton Myasthenic Syndrome, lichen planus, lupus nephritis, lymphocytic hypophysitis, Meniere's Disease, Miller Fish Syndrome/acute disseminated encephalomyeloradiculopathy (EMR), mixed connective tissue disease, multiple sclerosis (MS), muscular rheumatism, myalgic encephalomyelitis (ME), myasthenia gravis, ocular inflammation, pemphigus foliaceus, pemphigus vulgaris, pernicious anemia, polyarteritis nodosa, polychondritis, polyglandular syndromes (Whitaker's syndrome), polymyalgia rheumatica, polymyositis, primary agammaglobulinemia, primary biliary cirrhosis/autoimmune cholangiopathy, psoriasis, psoriatic arthritis, Raynaud's Phenomenon, Reiter's Syndrome/reactive arthritis, restenosis, rheumatic fever, rheumatic disease, sarcoidosis, Schmidt's syndrome, scleroderma, Sjörgen's Syndrome, stiff-man syndrome, systemic lupus erythematosus (SLE), systemic scleroderma, Takayasu arteritis, temporal arteritis/giant cell arteritis, thyroiditis, Type 1 diabetes, ulcerative colitis, uveitis, vasculitis, vitiligo, interstitial bowel disease or Wegener's Granulomatosis. In some embodiments, the inflammatory or autoimmune disorder is selected from interstitial bowel disease, transplant, Crohn's disease, ulcerative colitis, multiple sclerosis, asthma, rheumatoid arthritis, and psoriasis.

In some embodiments, the pharmaceutical composition is administered to modulate an autoimmune condition. For example, suppressing an immune response can be beneficial in methods for inhibiting rejection of a tissue, cell, or organ transplant from a donor by a recipient. Accordingly, in some embodiments, the pharmaceutical compositions described herein are used to limit or prevent graft-related or transplant related diseases or disorders, such as graft versus host disease (GVHD). In some embodiments, the pharmaceutical compositions are used to suppress autoimmune rejection of transplanted or grafted bone marrow, organs, skin, muscle, neurons, islets, or parenchymal cells.

Pharmaceutical compositions comprising engineered cells and the methods described herein can be used in adoptive cell transfer applications. In some embodiments, cell compositions comprising engineered cells can be used in associated methods to, for example, modulate immunological activity in an immunotherapy approach to the treatment of, for example, a mammalian cancer or, in other embodiments the treatment of autoimmune disorders. The methods employed generally comprise a method of contacting a TIP of the present invention with a mammalian cell under conditions that are permissive to specific binding of the affinity modified IgSF domain and modulation of the immunological activity of the mammalian cell. In some embodiments, immune cells (such as tumor infiltrating lymphocytes (TILs), T-cells (including CD8+ or CD4+ T-cells), or APCs) are engineered to express as a membrane protein and/or as a soluble variant CD80 polypeptide, immunomodulatory protein, or conjugate as described herein. The engineered cells can then be contact a mammalian cell, such as an APC, a second lymphocyte or tumor cell in which modulation of immunological activity is desired and under conditions that are permissive of specific binding of the affinity modified IgSF domain to a counter-structure on the mammalian cell such that immunological activity can be modulated in the mammalian cell. Cells can be contacted in vivo or ex vivo.

In some embodiments, the engineered cells are autologous cells. In other embodiments, the cells are allogeneic. In some embodiments, the cells are autologous engineered cells reinfused into the mammal from which it was isolated. In some embodiments, the cells are allogenic engineered cells infused into the mammal. In some embodiments, the cells are harvested from a patient's blood or tumor, engineered to express a polypeptide (such as the variant CD80 polypeptide, immunomodulatory protein, or conjugate as described herein), expanded in an in vitro culture system (for example, by stimulating the cells), and reinfused into the patient to mediate tumor destruction. In some embodiments, the method is conducted by adoptive cell transfer wherein cells expressing the TIP (e.g., a T-cell) are infused back into the patient. In some embodiments, the therapeutic compositions and methods of the invention are used in the treatment of a mammalian patient of cancers such as lymphoma, lymphoid leukemia, myeloid leukemia, cervical cancer, neuroblastoma, or multiple myeloma.

Subjects for Treatment

In some embodiments, the provided methods are for treating a subject that is or is suspected of having the disease or condition for which the therapeutic application is directed. In some cases, the subject for treatment can be selected prior to treatment based on one or more features or parameters, such as to to determine suitability for the therapy or to identify or select subjects for treatment in accord with any of the provided embodiments, including treatment with any of the provided variant CD80 polypeptides, immunomodulatory proteins, conjugates, engineered cells or infectious agents.

In some aspects, a subject is selected for treatment if at or immediately prior to the time of the administration of the pharmaceutical composition containing a variant CD80 polypeptide as described the subject has relapsed following remission after treatment with, or become refractory to, or is non-responsive to treatment with an antagonist of PD-1/PD-L1 or PD-1/PD-L2. In some embodiments, the antagonist is one that does not compete for binding to PD-L1 with a provided variant CD80 polypeptide to be used in the treatment methods. In some embodiments, the antagonist is an anti-PD-1 antibody. Exemplary anti-PD-1 antibodies are known and include, but are not limited to, nivolumab or pembrolizumab, or antigen binding fragments thereof.

In some embodiments, provided methods include diagnostic, prognostic or monitoring methods utilizing binding assays on various biological samples of patients having a disease or condition in which is known, suspected or that may be a candidate for treatment in accord with the provided embodiments. In some embodiments, the methods are carried out with reagents capable of detecting CD28, PD-L1 and/or CTLA-4 to select subjects having tumors or tumor cell infiltrates that express one or more binding partner of the variant CD80 polypeptide to be utilized in the therapeutic methods. Such reagents can be used as companion diagnostics for selecting subjects that are most likely to benefit from treatment with the provided molecules or pharmaceutical compositions and/or for predicting efficacy of the treatment.

In some embodiments, methods are provided for selecting subjects and/or predicting efficacy of treatment with provided therapies based on activity to antagonize PD-L1/PD-1 interaction and/or based on CD28 agonism, such as PD-L1-dependent CD28 costimulation, including in methods for increasing an immune response for treating a disease or condition and/or for treating a tumor or cancer. In some embodiments, the reagent is a PD-L1-binding reagent that specifically binds to PD-L1 on the surface of a cell, such as on the surface of a tumor cell or myeloid cells present in the tumor environment. In some embodiments, the reagent is a CD28-binding reagent that specifically binds to CD28 on the surface of a cell, such as on the surface of an infiltrating immune cell, such as a lymphocyte, e.g. a T cell. In some embodiments, the binding reagent can be an antibody or antigen-binding fragment, protein ligand or binding partner, an aptamer, an affimer, a peptide or a hapten. In some embodiments, such reagents can be used as a companion diagnostic for selecting or identifying subjects for treatment with a therapeutic agent or pharmaceutical composition provided herein containing a variant CD80 polypeptide that is or contains an IgSF domain (e.g. IgV) that exhibits increased binding to PD-L1 compared to the unmodified or wild-type CD80, including immunomodulatory proteins or conjugates. Included among such therapeutic agents are formats in which an extracellular portion of a CD80 variant polypeptide containing an affinity modified IgSF domain (e.g. IgV) is linked, directly or indirectly, to a multimerization domain, e.g. an Fe domain or region. In some embodiments, such a therapeutic agent is a variant CD80-Fc fusion protein.

In some embodiments, the binding reagent is an antibody or an antigen binding fragment thereof that specifically binds PD-L1. Various companion diagnostic reagents for detecting PD-L1, including intracellular or extracellular PD-L1, are known, e.g. Roach et al. (2016) Appl. Immunohistochem., Mol. Morphol., 24:392-397; Cogswell et al. (2017) Mol. Diagn. Ther. 21:85-93; International published patent application No. WO2015/181343 or WO2017/085307, or U.S. published patent application No. US2016/0009805 or US2017/0285037. Non limiting examples of anti-PD-L1 antibodies include, but are not limited to, mouse anti-PD-L1 clone 22C3 (Merck & Co.), rabbit anti-PD-L1 clone 28-8 (Bristol-Myers Squibb), rabbit anti-PD-L1 clones SP263 or SP142 (Spring Biosciences) and rabbit anti-PD-L1 antibody clone E1L3N. Such binding reagents can be used in histochemistry methods, including those available as Dako PD-L1 IHC 22C3 pharmDx assay, PD-L1 IHC 28-8 pharmDx assay, Ventana PD-L1 (SP263) assay, or Ventana PD-L1 (SP142) assay.

In some embodiments, the binding reagent is or contains a variant CD80 polypeptide provided herein, including any that exhibit altered (e.g. increased) binding affinity to PD-L1, CD28 and/or CTLA-4 compared to the unmodified or wildtype CD80 polypeptide. Thus, there also is provided binding reagents for use as a companion diagnostic containing any of the variant CD80 polypeptides provided herein. There also is provided a method for detecting PD-L1, CD28 and/or CTLA-4 in a biological sample by contacting the biological sample with a binding reagent comprising any of the variant CD80 polypeptides provided herein. In some aspects, binding reagents containing a variant CD80 polypeptide, including immunomodulatory proteins or conjugates provided herein, can be used either individually or in combination in diagnostic, prognostic or monitoring methods utilizing binding assays on various biological samples of patients having a disease or condition in which is known, suspected or that may be a candidate for treatment in accord with the provided embodiments. In some embodiments, the variant CD80 binding reagents and methods using variant CD80 binding reagents can be used to select subjects for treatment with any of the provided variant CD80 polypeptides, immunomodulatory proteins, conjugates, engineered cells or infectious agents. In some embodiments, the variant CD80 polypeptide of the binding reagent is the same as or contains the same affinity-modified IgSF domain (e.g. IgV domain) as the variant CD80 polypeptide used for treatment. In other embodiments, the variant CD80 polypeptide of the binding reagent is different from or contains a different affinity-modified IgSF domain (e.g. IgV domain) as the variant cD80 polypeptide for treatment.

A binding reagent that is or contains a variant CD80 polypeptide can contain any one or more of the amino acid modifications (e.g. amino acid substitutions, deletions or insertions) described herein, including any described in Section II. In some embodiments, a variant CD80 binding reagent can be chosen based on any desired binding activity, including, in some cases, based on the ability to specifically bind or detect one of, two of, or, in some cases, each of the ectodomains of PD-L1, CD28 and CTLA-4 on the surface of a cell in a biological sample.

In some embodiments, a binding reagent that is or contains a variant CD80 polypeptide specifically binds to the ectodomain of CTLA-4 on the surface of a cell, such as on the surface of a Treg cell. In some embodiments, the variant CD80 polypeptide is or contains an affinity-modified IgSF domain (e.g. IgV) that exhibits increased binding affinity to CTLA-4 compared to the unmodified or wildtype CD80, such as any provided herein. Examples of such variant CD80 polypeptides include any containing amino acid modification(s) in an IgSF domain (e.g. IgV) as described in Section II.A.1.

In some embodiments, a binding reagent that is or contains a variant CD80 polypeptide specifically binds to the ectodomain of CD28 on the surface of a cell, such as on the surface of a tumor infiltrating cell. In some embodiments, the variant CD80 polypeptide is or contains an affinity-modified IgSF domain (e.g. IgV) that exhibits increased binding affinity to CD28 compared to the unmodified or wildtype CD80, such as any provided herein. Exemplary of such variant CD80 polypeptides include any containing an amino acid modifications in an IgSF domain (e.g. IgV) as described in Section II.A.2.

In some embodiments, a binding reagent that is or contains a variant CD80 polypeptide specifically binds to the ectodomain of PD-L1 on the surface of a cell, such as on the surface of a tumor cell or myeloid cells present in the tumor environment. In some embodiments, the variant CD80 polypeptide is or contains an affinity-modified IgSF domain (e.g. IgV) that exhibits increased binding affinity to PD-L1 compared to the unmodified or wildtype CD80, such as any provided herein. Exemplary of such variant CD80 polypeptides include any containing an amino acid modifications in an IgSF domain (e.g. IgV) as described in Section II.A.3.

A variant CD80 binding reagent can be provided in any format, including any format as described herein, that is suitable for use in binding assays and detection methods. In some embodiments, the binding reagent contains a variant CD80 polypeptide that is or contains an IgSF domain (e.g. IgV), including immunomodulatory proteins or conjugates. Included among such therapeutic agents are formats in which an extracellular portion of a CD80 variant polypeptide containing an affinity modified IgSF domain (e.g. IgV) is linked, directly or indirectly, to a multimerization domain, e.g. an Fc domain or region. In some embodiments, such a binding reagent is a variant CD80-Fc fusion protein. In some embodiments, the Fc domain is a non-human Fc. In some embodiments, the Fc is a mouse Fc, such as of a mouse IgG, for example of a mouse IgG1, mouse IgG2a or mouse IgG2b or other mouse isotype. In some embodiments, the mouse Fc is or comprises the sequence set forth in SEQ ID NO: 3040 or a sequence of amino acids that exhibits at least 85%, 86%, 87%, 88%, 89%, 90%, 91%, 92%, 93%, 94%, 95%, 96%, 97%, 98% or 99% sequence identity to SEQ ID NO:3040. In some embodiments, the mouse Fc is capable of detection with an anti-mouse IgG secondary antibody (e.g. goat anti-mouse IgG). In some embodiments, the Fc is a rabbit Fc, such as of rabbit IgG. In some embodiments, the rabbit Fc is or comprises the sequence set forth in SEQ ID NO: 3039 or a sequence of amino acids that exhibits at least 85%, 86%, 87%, 88%, 89%, 90%, 91%, 92%, 93%, 94%, 95%, 96%, 97%, 98% or 99% sequence identity to SEQ ID NO:3039. In some embodiments, the rabbit Fc is capable of detection with an anti-rabbit IgG secondary antibody (e.g. goat anti-rabbit IgG). The variant CD80 polypeptide of the provided binding reagents can be directly or indirectly linked to the multimerization domain, such as to an Fc domain. In some aspects, the variant CD80 polypeptide of the provided binding reagents is indirectly linked to the Fc sequence, such as via a linker, including any as described in Section II.

The binding reagent can be conjugated, such as fused, directly or indirectly to a detectable label for detection. In some cases, the binding reagent is linked or attached to a moiety that permits either direct detection or detection via secondary agents, such as via antibodies that bind to the reagent or a portion of the reagent and that are coupled to a detectable label. Exemplary detectable labels include, for example, chemiluminescent moieties, bioluminescent moieties, fluorescent moieties, radionuclides, and metals. Methods for detecting labels are well known in the art. Such a label can be detected, for example, by visual inspection, by fluorescence spectroscopy, by reflectance measurement, by flow cytometry, by X-rays, by a variety of magnetic resonance methods such as magnetic resonance imaging (MRI) and magnetic resonance spectroscopy (MRS). Methods of detection also include any of a variety of tomographic methods including computed tomography (CT), computed axial tomography (CAT), electron beam computed tomography (EBCT), high resolution computed tomography (HRCT), hypocycloidal tomography, positron emission tomography (PET), single-photon emission computed tomography (SPECT), spiral computed tomography, and ultrasonic tomography. Exemplary detectable labels include, for example, chemiluminescent moieties, bioluminescent moieties, fluorescent moieties, radionuclides, and metals. Among detectable labels are fluorescent probes or detectable enzymes, e.g. horseradish perioxidase.

The binding reagents can detect the binding partner, e.g. PD-L1, CD28 or CTLA-4, using any binding assay known to one of skill in the art including, in vitro or in vivo assays. Exemplary binding assays that can be used to assess, evaluate, determine, quantify and/or otherwise specifically detect expression or levels of a binding partner, e.g. PD-L1, CD28 or CTLA-4, in a sample include, but are not limited to, solid phase binding assays (e.g. enzyme linked immunosorbent assay (ELISA)), radioimmunoassay (RIA), immunoradiometric assay, fluorescence assay, chemiluminescent assay, bioluminescent assay, western blot and histochemistry methods, such as immunohistochemistry (IHC) or pseudo immunohistochemistry using a non-antibody binding agent. In solid phase binding assay methods, such as ELISA methods, for example, the assay can be a sandwich format or a competitive inhibition format. In other examples, in vivo imaging methods can be used. The binding assay can be performed on samples obtained from a patient body fluid, cell or tissue sample of any type, including from plasma, urine, tumor or suspected tumor tissues (including fresh, frozen, and fixed or paraffin embedded tissue), lymph node or bone marrow. In exemplary methods to select a subject for treatment in accord with the therapeutic methods provided herein, harvesting of the sample, e.g. tumor tissue, is carried out prior to treatment of the subject.

In some embodiments, the binding assay is a tissue staining assay to detect the expression or levels of a binding partner in a tissue or cell sample. Tissue staining methods include, but are not limited to, cytochemical or histochemical methods, such as immunohistochemistry (IHC) or histochemistry using a non-antibody binding agent (e.g. pseudo immunohistochemistry). Such histochemical methods permit quantitative or semi-quantitative detection of the amount of the binding partner in a sample, such as a tumor tissue sample. In such methods, a tissue sample can be contacted with a binding reagent, e.g. PD-L1 binding reagent, and in particular one that is detectably labeled or capable of detection, under conditions that permit binding to a tissue- or cell-associated binding partner.

A sample for use in the methods provided herein as determined by histochemistry can be any biological sample that is associated with the disease or condition, such as a tissue or cellular sample. For example, a tissue sample can be solid tissue, including a fresh, frozen and/or preserved organ or tissue sample or biopsy or aspirate, or cells. In some examples, the tissue sample is tissue or cells obtained from a solid tumor, such as primary and metastatic tumors, including but not limited to, breast, colon, rectum, lung, stomach, ovary, cervix, uterus, testes, bladder, prostate, thyroid and lung cancer tumors. In particular examples, the sample is a tissue sample from a cancer that is a late-stage cancer, a metastatic cancer, undifferentiated cancer, ovarian cancer, in situ carcinoma (ISC), squamous cell carcinoma (SCC), prostate cancer, pancreatic cancer, non-small cell lung cancer, breast cancer, colon cancer.

In some aspects, when the tumor is a solid tumor, isolation of tumor cells can be achieved by surgical biopsy. Biopsy techniques that can be used to harvest tumor cells from a subject include, but are not limited to, needle biopsy, CT-guided needle biopsy, aspiration biopsy, endoscopic biopsy, bronchoscopic biopsy, bronchial lavage, incisional biopsy, excisional biopsy, punch biopsy, shave biopsy, skin biopsy, bone marrow biopsy, and the Loop Electrosurgical Excision Procedure (LEEP). Typically, a non-necrotic, sterile biopsy or specimen is obtained that is greater than 100 mg, but which can be smaller, such as less than 100 mg, 50 mg or less, 10 mg or less or 5 mg or less; or larger, such as more than 100 mg, 200 mg or more, or 500 mg or more, 1 gm or more, 2 gm or more, 3 gm or more, 4 gm or more or 5 gm or more. The sample size to be extracted for the assay can depend on a number of factors including, but not limited to, the number of assays to be performed, the health of the tissue sample, the type of cancer, and the condition of the subject. The tumor tissue is placed in a sterile vessel, such as a sterile tube or culture plate, and can be optionally immersed in an appropriate medium.

In some embodiments, tissue obtained from the patient after biopsy is fixed, such as by formalin (formaldehyde) or glutaraldehyde, for example, or by alcohol immersion. For histochemical methods, the tumor sample can be processed using known techniques, such as dehydration and embedding the tumor tissue in a paraffin wax or other solid supports known to those of skill in the art (see Plenat et ah, (2001) Ann Pathol. January 21(1):29-47), slicing the tissue into sections suitable for staining, and processing the sections for staining according to the histochemical staining method selected, including removal of solid supports for embedding by organic solvents, for example, and rehydration of preserved tissue.

In some embodiments, histochemistry methods are employed. In some cases, the binding reagent is directly attached or linked to a detectable label or other moiety for direct or indirect detection. Exemplary detectable regents including, but are not limited to, biotin, a fluorescent protein, bioluminescent protein or enzyme. In other examples, the binding reagents are conjugated, e.g. fused, to peptides or proteins that can be detected via a labeled binding partner or antibody. In some examples, a binding partner can be detected by HC methods using a labeled secondary reagent, such as labeled antibodies, that recognize one or more regions, e.g. epitopes, of the binding reagent.

In some embodiments, the resulting stained specimens, such as obtained by histochemistry methods, are each imaged using a system for viewing the detectable signal and acquiring an image, such as a digital image of the staining. Methods for image acquisition are well known to one of skill in the art. For example, once the sample has been stained, any optical or non-optical imaging device can be used to detect the stain or biomarker label, such as, for example, upright or inverted optical microscopes, scanning confocal microscopes, cameras, scanning or tunneling electron microscopes, canning probe microscopes and imaging infrared detectors. In some examples, the image can be captured digitally. The obtained images can then be used for quantitatively or semi-quantitatively determining the amount of a binding partner, e.g. PD-L1, in the sample. Various automated sample processing, scanning and analysis systems suitable for use with immunohistochemistry are available in the art. Such systems can include automated staining and microscopic scanning, computerized image analysis, serial section comparison (to control for variation in the orientation and size of a sample), digital report generation, and archiving and tracking of samples (such as slides on which tissue sections are placed). Cellular imaging systems are commercially available that combine conventional light microscopes with digital image processing systems to perform quantitative analysis on cells and tissues, including immunostained samples. See, e.g., the CAS-200 system (Becton, Dickinson & Co.). In particular, detection can be made manually or by image processing techniques involving computer processors and software. Using such software, for example, the images can be configured, calibrated, standardized and/or validated based on factors including, for example, stain quality or stain intensity, using procedures known to one of skill in the art (see e.g. published U.S. patent Appl. No. US20100136549).

In some embodiments, a biological sample is detected for cells surface positive for a binding partner, e.g. PD-L1, CD28 or CTLA-4, if there is a detectable expression level of the binding partner (e.g. following contacting with the binding reagent and detection of bound binding reagent) in at least or at least about or about 1% of the cells, at least or at least about or about 5% of the cells, at least or at least about or about 10% of the cells, at least or at least about or about 20% of the cells, at least or at least about or about 40% of the cells or more.

In some embodiments, the biological sample is a tumor tissue sample comprising stromal cells, tumor cells or tumor infiltrating cells, such as tumor infiltrating immune cells, e.g. tumor infiltrating lymphocytes. In some embodiments, the tumor tissue sample is detected for cells surface positive for PD-L1 if there is a detectable expression level of the binding partner (e.g. following contacting with the binding reagent and detection of bound binding reagent) in at least or at least about or about 1% of the cells, at least or at least about or about 5% of the cells, at least or at least about or about 10% of the cells, at least or at least about or about 20% of the cells, at least or at least about or about 40% of the cells or more. In some embodiments, the cells are tumor cells or tumor infiltrating immune cells. In some embodiments, the tumor tissue sample is detected for cells surface positive for CD28 if there is a detectable expression level of the binding partner (e.g. following contacting with the binding reagent and detection of bound binding reagent) in at least or at least about or about 1% of the cells, at least or at least about or about 5% of the cells, at least or at least about or about 10% of the cells, at least or at least about or about 20% of the cells, at least or at least about or about 40% of the cells or more. In some embodiments, the cells are tumor infiltrating immune lymphocytes.

VIII. Exemplary Embodiments

Among the provided embodiments are:

1. A variant CD80 polypeptide comprising an IgV domain or a specific binding fragment thereof, an IgC domain or a specific binding fragment thereof, or both, wherein the variant CD80 polypeptide comprises one or more amino acid modifications at one or more positions in an unmodified CD80 or specific binding fragment thereof, corresponding to position(s) 7, 23, 26, 30, 34, 35, 46, 51, 55, 57, 58, 65, 71, 73, 78, 79, 82, or 84 with reference to numbering of SEQ ID NO: 2.

2. The variant CD80 polypeptide of embodiment 1, wherein the CD80 polypeptide comprises one or more amino acid modifications in an unmodified CD80 or specific binding fragment thereof, corresponding to position(s) 26, 35, 46, 57, or 71 with reference to numbering of SEQ ID NO: 2.

3. The variant CD80 polypeptide of embodiment 1 or embodiment 2, wherein the one or more amino acid modification is an amino acid substitution, insertion or deletion.

4. The variant CD80 polypeptide of any of embodiments 1-3, wherein the variant CD80 polypeptide comprises one or more amino acid modifications in an unmodified CD80 or specific binding fragment thereof, selected from among E7D, E23D, E23G, A26D, A26E, A26G, A26H, A26K, A26N, A26P, A26Q, A26R, A26S, A26T, I30F, I30T, I30V, K34E, E35D, E35G, D46E, D46N, D46V, P51A, N55D, N55I, T57A, T57I, 158V, L65P, A71D, A71G, R73H, R73S, G78A, T79A, T79I, T79L, T79M, T79P, C82R, V84A, and V84I, where the position(s) of the amino acid modification(s) correspond(s) to the numbering of positions of CD80 set forth in SEQ ID NO: 2.

5. The variant CD80 polypeptide of any of embodiments 1-4, wherein the one or more amino acid modification is selected from among: I30F/L70P, Q27H/T41S/A71D, 130T/L70R, T13R/C16R/L70Q/A71D, T57I, M431/C82R, V22L/M38V/M47T/A71D/L85M, I30V/T57I/L70P/A71D/A91T, V22I/L70M/A71D, N55D/L70P/E77G, T57A/I69T, N55D/K86M, L72P/T79I, T79P, E35D/M47I/L65P/D90N, L25S/E35D/M47I/D90N, A71D, T13A/I61N/A71D, K34E/T41A/L72V, T41S/A71D/V84A, E35D/A71D, E35D/M47I, K36R/G78A, S44P/A71D, Q27H/M43I/A71D/R73S, Q33R/K54N/T57I/I67V/A71D, E35D/T57I/L70Q/A71D, M42I/I61V/A71D, P51A/A71D, H18Y/M47I/T57I/A71G, V20I/M47V/T57I/V84I, V20I/M47V/A71D, A71D/L72V/E95K, V22L/E35G/A71D/L72P, E35D/A71D, E35D/I67L/A71D, Q27H/E35G/A71D/L72P/T79I, T13R/M42V/M47I/A71D, E35D, E35D/M47I/L70M, E35D/A71D/L72V, E35D/M43L/L70M, A26P/E35D/M43I/L85Q/E88D, E35D/D46V/L85Q, Q27L/E35D/M47I/T57I/L70Q/E88D, M47V/I69F/A71D/V83I, E35D/T57A/A71D/L85Q, H18Y/A26T/E35D/A71D/L85Q, E35D/M47L, E23D/M42V/M43I/I58V/L70R, V68M/L70M/A71D/E95K, N55I/T57I/I69F, E35D/M43I/A71D, T41S/T57I/L70R, H18Y/A71D/L72P/E88V, V20I/A71D, E23G/A26S/E35D/T62N/A71D/L72V/L85M, A12T/E24D/E35D/D46V/I61V/L72P/E95V, V22L/E35D/M43L/A71G/D76H, E35G/K54E/A71D/L72P, L70Q/A71D, A26E/E35D/M47L/L85Q, D46E/A71D, Y31H/E35D/T41S/V68L/K93R/R94W, A26E/Q33R/E35D/M47L/L85Q/K86E, A26E/Q33R/E35D/M47L/L85Q, E35D/M47L/L85Q, A26E/Q33L/E35D/M47L/L85Q, A26E/Q33L/E35D/M47L, H18Y/A26E/Q33L/E35D/M47L/L85Q, Q33L/E35D/M47I, H18Y/Q33L/E35D/M47I, Q33L/E35D/D46E/M47I, Q33R/E35D/D46E/M47I, H18Y/E35D/M47L, Q33L/E35D/M47V, Q33L/E35D/M47V/T79A, Q33L/E35D/T41S/M47V, Q33L/E35D/M47I/L85Q, Q33L/E35D/M47I/T62N/L85Q, Q33L/E35D/M47V/L85Q, A26E/E35D/M43T/M47L/L85Q/R94Q, Q33R/E35D/K37E/M47V/L85Q, V22A/E23D/Q33L/E35D/M47V, E24D/Q33L/E35D/M47V/K54R/L85Q, S15P/Q33L/E35D/M47L/L85Q, E7D/E35D/M47I/L97Q, Q33L/E35D/T41S/M43I, E35D/M47I/K54R/L85E, Q33K/E35D/D46V/L85Q, Y31S/E35D/M47L/T79L/E88G, H18L/V22A/E35D/M47L/N48T/L85Q, Q27H/E35D/M47L/L85Q/R94Q/E95K, Q33K/E35D/M47V/K89E/K93R, E35D/M47I/E77A/L85Q/R94W, A26E/E35D/M43I/M47L/L85Q/K86E/R94W, Q27H/Q33L/E35D/M47V/N55D/L85Q/K89N, H18Y/V20A/Q33L/E35D/M47V/Y53F, V22A/E35D/V68E/A71D, Q33L/E35D/M47L/A71G/F92S, V22A/R29H/E35D/D46E/M47I, Q33L/E35D/M43I/L85Q/R94W, H18Y/E35D/V68M/L97Q, Q33L/E35D/M47L/V68M/L85Q/E88D, Q33L/E35D/M43V/M47I/A71G, E35D/M47L/A71G/L97Q, E35D/M47V/A71G/L85M/L97Q, H18Y/Y31H/E35D/M47V/A71G/L85Q, E35D/D46E/M47V/L97Q, E35D/D46V/M47I/A71G/F92V, E35D/M47V/T62A/A71G/V83A/Y87H/L97M, Q33L/E35D/N48K/L85Q/L97Q, E35D/L85Q/K93T/E95V/L97Q, E35D/M47V/N48K/V68M/K89N, Q33L/E35D/M47I/N48D/A71G, R29H/E35D/M43V/M47I/149V, Q27H/E35D/M47I/L85Q/D90G, E35D/M47I/L85Q/D90G, E35D/M47I/T62S/L85Q, A26E/E35D/M47L/A71G, E35D/M47I/Y87Q/K89E, V22A/E35D/M47I/Y87N, H18Y/A26E/E35D/M47L/L85Q/D90G, E35D/M47L/A71G/L85Q, E35D/M47V/A71G/E88D, E35D/A71G, E35D/M47V/A71G, 130V/E35D/M47V/A71G/A91V, I30V/Y31C/E35D/M47V/A71G/L85M, V22D/E35D/M47L/L85Q, H18Y/E35D/N48K, E35D/T41S/M47V/A71G/K89N, E35D/M47V/N48T/L85Q, E35D/D46E/M47V/A71D/D90G, E35D/D46E/M47V/A71D, E35D/T41S/M431/A71G/D90G, E35D/T41S/M43I/M47V/A71G, E35D/T41S/M43I/M47L/A71G, H18Y/V22A/E35D/M47V/T62S/A71G, H18Y/A26E/E35D/M47L/V68M/A71G/D90G, E35D/K37E/

M47V/N48D/L85Q/D90N, Q27H/E35D/D46V/M47L/A71G, V22L/Q27H/E35D/M47I/A71G, E35D/D46V/M47L/V68M/L85Q/E88D, E35D/T41S/M43V/M47I/L70M/A71G, E35D/D46E/M47V/N63D/L85Q, E35D/M47V/T62A/A71D/K93E, E35D/D46E/M47V/V68M/D90G/K93E, E35D/M43I/M47V/K89N, E35D/M47L/A71G/L85M/F92Y, E35D/M42V/M47V/E52D/L85Q, V22D/E35D/M47L/L70M/L97Q, E35D/T41S/M47V/L97Q, E35D/Y53H/A71G/D90G/L97R, E35D/A71D/L72V/R73H/E81K, Q33L/E35D/M43I/Y53F/T62S/L85Q, E35D/M38T/D46E/M47V/N48S, Q33R/E35D/M47V/N48K/L85M/F92L, E35D/M38T/M43V/M47V/N48R/L85Q, T28Y/Q33H/E35D/D46V/M47I/A71G, E35D/N48K/L72V, E35D/T41S/N48T, D46V/M47I/A71G, M47I/A71G, E35D/M43I/M47L/L85M, E35D/M43I/D46E/A71G/L85M, H18Y/E35D/M47L/A71G/A91S, E35D/M47I/N48K/I61F, E35D/M47V/T62S/L85Q, M43I/M47L/A71G, E35D/M47V, E35D/M47L/A71G/L85M, V22A/E35D/M47L/A71G, E35D/M47L/A71G, E35D/D46E/M47I, Q27H/E35D/M47I, E35D/D46E/L85M, E35D/D46E/A91G, E35D/D46E, E35D/L97R, H18Y/E35D, Q27L/E35D/M47V/I61V/L85M, E35D/M47V/I61V/L85M, E35D/M47V/L85M/R94Q, E35D/M47V/N48K/L85M, H18Y/E35D/M47V/N48K, A26E/Q27R/E35D/M47L/N48Y/L85Q, E35D/D46E/M47L/V68M/L85Q/F92L, E35D/M47I/T62S/L85Q/E88D, E24D/Q27R/E35D/T41S/M47V/L85Q, S15T/H18Y/E35D/M47V/T62A/N64S/A71G/L85Q/D90N, E35D/M47L/V68M/A71G/L85Q/D90G, H18Y/E35D/M47I/V68M/A71G/R94L, Q33R/M47V/T62N/A71G, H18Y/V22A/E35D/T41S/M47V/T62N/A71G/A91G, E35D/M47L/L70M, E35D/M47L/V68M, E35D/D46V/M47L/V68M/E88D, E35D/D46V/M47L/V68M/D90G, E35D/D46V/M47L/V68M/K89N, E35D/D46V/M47L/V68M/L85Q, E35D/D46V/M47L/V68M, E35D/D46V/M47L/V70M, E35D/D46V/M47L/V70M/L85Q, E35D/M47V/N48K/V68M, E24D/E35D/M47L/V68M/E95V/L97Q, E35D/D46E/M47I/T62A/V68M/L85M/Y87C, E35D/D46E/M47I/V68M/L85M, E35D/D46E/M47L/V68M/A71G/Y87C/K93R, E35D/D46E/M47L/V68M/T79M/L85M, E35D/D46E/M47L/V68M/T79M/L85M/L97Q, E35D/D46E/M47V/V68M/L85Q, E35D/M43I/M47L/V68M, E35D/M47I/V68M/Y87N, E35D/M47L/V68M/E95V/L97Q, E35D/M47L/Y53F/V68M/A71G/K93R/E95V, E35D/M47V/N48K/V68M/A71G/L85M, E35D/M47V/N48K/V68M/L85M, E35D/M47V/V68M/L85M, E35D/M47V/V68M/L85M/Y87D, E35D/T41S/D46E/M47I/V68M/K93R/E95V, H18Y/E35D/D46E/M47I/V68M/R94L, H18Y/E35D/M38I/M47L/V68M/L85M, H18Y/E35D/M47I/V68M/Y87N, H18Y/E35D/M47L/V68M/A71G/L85M, H18Y/E35D/M47L/V68M/E95V/L97Q, H18Y/E35D/M47L/Y53F/V68M/A71G, H18Y/E35D/M47L/Y53F/V68M/A71G/K93R/E95V, H18Y/E35D/M47V/V68M/L85M, H18Y/E35D/V68M/A71G/R94Q/E95V, H18Y/E35D/V68M/L85M/R94Q, H18Y/E35D/V68M/T79M/L85M, H18Y/V22D/E35D/M47V/N48K/V68M, Q27L/Q33L/E35D/T41S/M47V/N48K/V68M/L85M, Q33L/E35D/M47V/T62S/V68M/L85M, Q33R/E35D/M38I/M47L/V68M, R29C/E35D/M47L/V68M/A71G/L85M, S21P/E35D/K37E/D46E/M47I/V68M, S21P/E35D/K37E/D46E/M47I/V68M/R94L, T13R/E35D/M47L/V68M, T13R/H18Y/E35D/V68M/L85M/R94Q, T13R/Q27L/Q33L/E35D/T41S/M47V/N48K/V68M/L85M, T13R/Q33L/E35D/M47L/V68M/L85M, T13R/Q33L/E35D/M47V/T62S/V68M/L85M, T13R/Q33R/E35D/M38I/M47L/V68M, T13R/Q33R/E35D/M381/M47L/V68M/E95V/L97Q, T13R/Q33R/E35D/M381/M47L/V68M/L85M, T13R/Q33R/E35D/M381/M47L/V68M/L85M/R94Q, T13R/Q33R/E35D/M47L/V68M, T13R/Q33R/E35D/M47L/V68M/L85M, V22D/E24D/E35D/M47L/V68M, V22D/E24D/E35D/M47L/V68M/L85M/D90G, V22D/E24D/E35D/M47V/V68M, E35D/D46V, E35D/V68M, E35D/L85Q, D46V/M47L, D46V/V68M, D46V/L85Q, E35D/D46V/M47L, E35D/D46V/V68M, E35D/D46V/L85Q, E35D/V68M/L85Q, D46V/M47L/V68M, D46V/M47L/L85Q, D46V/V68M/L85Q, E35D/D46V/M47L/L85Q, E35D/D46V/V68M/L85Q, E35D/M47L/V68M/L85Q, D46V/M47L/V68M/L85Q, E35D/N48K, E35D/K89N, E35D/M47V/N48K, E35D/M47V/V68M, E35D/M47V/K89N, E35D/N48K/V68M, E35D/N48K/K89N, E35D/V68M/K89N, E35D/M47V/N48K/K89N, E35D/M47V/V68M/K89N, E35D/N48K/V68M/K89N, E35D/D46V/M47V/N48K/V68M, E35D/D46V/M47V/V68M/L85Q, E35D/D46V/M47V/V68M/K89N, E35D/M47V/N48K/V68M/L85Q, E35D/M47V/V68M/L85Q/K89N, A26E/E35D/M47L/V68M/A71G/D90G, H18Y/E35D/M47L/V68M/A71G/D90G, H18Y/A26E/M47L/V68M/A71G/D90G, H18Y/A26E/E35D/V68M/A71G/D90G, H18Y/A26E/E35D/M47L/A71G/D90G, H18Y/A26E/E35D/M47L/V68M/D90G, H18Y/A26E/E35D/M47L/V68M/A71G, E35D/M47L/V68M/A71G/D90G, H18Y/M47L/V68M/A71G/D90G, H18Y/A26E/V68M/A71G/D90G, H18Y/A26E/E35D/A71G/D90G, H18Y/A26E/E35D/M47L/D90G, H18Y/A26E/E35D/M47L/V68M, A26E/M47L/V68M/A71G/D90G, A26E/E35D/V68M/A71G/D90G, A26E/E35D/M47L/A71G/D90G, A26E/E35D/M47L/V68M/D90G, A26E/E35D/M47L/V68M/A71G, H18Y/E35D/V68M/A71G/D90G, H18Y/E35D/M47L/A71G/D90G, H18Y/E35D/M47L/V68M/D90G, H18Y/E35D/M47L/V68M/A71G, H18Y/A26E/M47L/A71G/D90G, H18Y/A26E/M47L/V68M/D90G, H18Y/A26E/M47L/V68M/A71G, H18Y/A26E/E35D/V68M/D90G, H18Y/A26E/E35D/V68M/A71G, H18Y/A26E/E35D/M47L/A71G, M47L/V68M/A71G/D90G, H18Y/V68M/A71G/D90G, H18Y/A26E/A71G/D90G, H18Y/A26E/E35D/D90G, H18Y/A26E/E35D/M47L, E35D/V68M/A71G/D90G, E35D/M47L/A71G/D90G, E35D/M47L/V68M/D90G, E35D/M47L/V68M/A71G, A26E/V68M/A71G/D90G, A26E/M47L/A71G/D90G, A26E/M47L/V68M/D90G, A26E/M47L/V68M/A71G, A26E/E35D/A71G/D90G, A26E/E35D/V68M/D90G, A26E/E35D/V68M/A71G, A26E/E35D/M47L/D90G, A26E/E35D/M47L/V68M, H18Y/M47L/A71G/D90G, H18Y/M47L/V68M/A71G, H18Y/E35D/A71G/D90G, H18Y/E35D/V68M/D90G, H18Y/E35D/V68M/A71G, H18Y/E35D/M47L/D90G, H18Y/E35D/M47L/A71G, H18Y/E35D/M47L/V68M, H18Y/A26E/V68M/D90G, H18Y/A26E/V68M/A71G, H18Y/A26E/M47L/D90G, H18Y/A26E/M47L/A71G, H18Y/A26E/M47L/V68M, H18Y/A26E/E35D/A71G H18Y/A26E/E35D/V68M, H18Y/E35D/M47V/V68M/A71G, H18C/A26P/E35D/M47L/V68M/A71G, H18I/A26P/E35D/M47V/V68M/A71G, H18L/A26N/D46E/V68M/A71G/D90G, H18L/E35D/M47V/V68M/A71G/D90G, H18T/A26N/E35D/M47L/V68M/A71G, H18V/A26K/E35D/M47L/V68M/A71G, H18V/A26N/E35D/M47V/V68M/A71G, H18V/A26P/E35D/M47V/V68L/A71G, H18V/A26P/E35D/M47L/V68M/A71G, H18V/E35D/M47V/V68M/A71G/D90G, H18Y/A26P/E35D/M47I/V68M/A71G, H18Y/A26P/E35D/M47V/V68M/A71G, H18Y/E35D/M47V/V68L/A71G/D90G, H18Y/E35D/M47V/V68M/A71G/D90G, A26P/E35D/M47I/V68M/A71G/D90G, H18V/A26G/E35D/M47V/V68M/A71G/D90G, H18V/A26S/E35D/M47L/V68M/A71G/D90G, H18V/A26R/E35D/M47L/V68M/A71G/

D90G, H18V/A26D/E35D/M47V/V68M/A71G/D90G, H18V/A26Q/E35D/M47V/V68L/A71G/D90G, H18A/A26P/E35D/M47L/V68M/A71G/D90G, H18A/A26N/E35D/M47L/V68M/A71G/D90G, H18F/A26P/E35D/M47I/V68M/A71G/D90G, H18F/A26H/E35D/M47L/V68M/A71G/D90G, H18F/A26N/E35D/M47V/V68M/A71G/D90K, H18Y/A26N/E35D/M47F/V68M/A71G/D90G, H18Y/A26P/E35D/M47Y/V68I/A71G/D90G, H18Y/A26Q/E35D/M47T/V68M/A71G/D90G, H18R/A26P/E35D/D46N/M47V/V68M/A71G/D90P, and H18F/A26D/E35D/D46E/M47T/V68M/A71G/D90G, where the position(s) of the amino acid substitution(s) correspond(s) to the positions of CD80 set forth in SEQ ID NO: 2.

6. A variant CD80 polypeptide comprising an IgV domain or a specific binding fragment thereof, an IgC domain or a specific binding fragment thereof, or both, wherein the variant CD80 polypeptide comprises one or more amino acid modifications in an unmodified CD80 or specific binding fragment thereof, selected from among E7D, T13A, T13R, S15P, S15T, C16R, H18A, H18C, H18F, H18I, H18T, H18V, V20A, V20I, V22D, V22I, V22L, E23D, E23G, E24D, L25S, A26D, A26E, A26G, A26H, A26K, A26N, A26P, A26Q, A26R, A26S, A26T, Q27H, Q27L, T28Y, 130F, 130T, Y31C, Y31S, Q33E, Q33K, Q33L, Q33R, K34E, E35D, E35G, K36R, T41S, M42I, M42V, M43L, M43T, D46E, D46N, D46V, M47F, M47I, M47L, M47V, M47Y, N48H, N48K, N48R, N48S, N48T, N48Y, P51A, Y53F, Y53H, K54E, K54N, K54R, N55D, N55I, T57A, T57I, 158V, I61F, I61V, T62A, T62N, N63D, L65P, I67L, I67V, V68E, V68I, V68L, I69F, L70M, A71D, A71G, L72V, R73H, R73S, P74S, D76H, E77A, G78A, T79A, T79I, T79L, T79M, T79P, E81G, E81K, C82R, V84A, V84I, L85E, L85M, L85Q, K86M, Y87C, Y87D, Y87H, Y87Q, E88V, D90P, F92S, F92V, K93T, R94Q, R94W, E95D, E95V, L97M, and L97Q, where the position(s) of the amino acid substitution(s) correspond(s) to the numbering of positions of CD80 set forth in SEQ ID NO: 2.

7. The variant CD80 polypeptide of embodiment 6, wherein the one or more amino acid modification is selected from among: I30F/L70P, Q27H/T41S/A71D, I30T/L70R, T13R/C16R/L70Q/A71D, T57I, M431/C82R, V22L/M38V/M47T/A71D/L85M, I30V/T57I/L70P/A71D/A91T, V22I/L70M/A71D, N55D/L70P/E77G, T57A/I69T, N55D/K86M, L72P/T79I, L70P/F92S, T79P, E35D/M47I/L65P/D90N, L25S/E35D/M47I/D90N, A71D, E81K/A91S, A12V/M47V/L70M, K34E/T41A/L72V, T41S/A71D/V84A, E35D/A71D, E35D/M47I, K36R/G78A, Q33E/T41A, M47V/N48H, M47L/V68A, S44P/A71D, Q27H/M43I/A71D/R73S, E35D/T57I/L70Q/A71D, M47I/E88D, M42I/I61V/A71D, P51A/A71D, H18Y/M47I/T57I/A71G, V20I/M47V/T57I/V84I, V20I/M47V/A71D, A71D/L72V/E95K, V22L/E35G/A71D/L72P, E35D/A71D, E35D/I67L/A71D, Q27H/E35G/A71D/L72P/T79I, T13R/M42V/M47I/A71D, E35D, E35D/M47I/L70M, E35D/A71D/L72V, E35D/M43L/L70M, A26P/E35D/M43I/L85Q/E88D, E35D/D46V/L85Q, Q27L/E35D/M47I/T57I/L70Q/E88D, M47V/I69F/A71D/V83I, E35D/T57A/A71D/L85Q, H18Y/A26T/E35D/A71D/L85Q, E35D/M47L, E23D/M42V/M43I/I58V/L70R, V68M/L70M/A71D/E95K, N55I/T57I/I69F, E35D/M43I/A71D, T41S/T57I/L70R, H18Y/A71D/L72P/E88V, V20I/A71D, E23G/A26S/E35D/T62N/A71D/L72V/L85M, A12T/E24D/E35D/D46V/I61V/L72P/E95V, V22L/E35D/M43L/A71G/D76H, E35G/K54E/A71D/L72P, L70Q/A71D, A26E/E35D/M47L/L85Q, D46E/A71D, Y31H/E35D/T41S/V68L/K93R/R94W, A26E/Q33R/E35D/M47L/L85Q/K86E, A26E/Q33R/E35D/M47L/L85Q, E35D/M47L/L85Q, A26E/Q33L/E35D/M47L/L85Q, A26E/Q33L/E35D/M47L, H18Y/A26E/Q33L/E35D/M47L/L85Q, Q33L/E35D/M47I, H18Y/Q33L/E35D/M47I, Q33L/E35D/D46E/M47I, Q33R/E35D/D46E/M47I, H18Y/E35D/M47L, Q33L/E35D/M47V, Q33L/E35D/M47V/T79A, Q33L/E35D/T41S/M47V, Q33L/E35D/M47I/L85Q, Q33L/E35D/M47I/T62N/L85Q, Q33L/E35D/M47V/L85Q, A26E/E35D/M43T/M47L/L85Q/R94Q, Q33R/E35D/K37E/M47V/L85Q, V22A/E23D/Q33L/E35D/M47V, E24D/Q33L/E35D/M47V/K54R/L85Q, S15P/Q33L/E35D/M47L/L85Q, E7D/E35D/M47I/L97Q, Q33L/E35D/T41S/M43I, E35D/M47I/K54R/L85E, Q33K/E35D/D46V/L85Q, Y31S/E35D/M47L/T79L/E88G, H18L/V22A/E35D/M47L/N48T/L85Q, Q27H/E35D/M47L/L85Q/R94Q/E95K, Q33K/E35D/M47V/K89E/K93R, E35D/M47I/E77A/L85Q/R94W, A26E/E35D/M43I/M47L/L85Q/K86E/R94W, Q27H/Q33L/E35D/M47V/N55D/L85Q/K89N, H18Y/V20A/Q33L/E35D/M47V/Y53F, V22A/E35D/V68E/A71D, Q33L/E35D/M47L/A71G/F92S, V22A/R29H/E35D/D46E/M47I, Q33L/E35D/M43I/L85Q/R94W, H18Y/E35D/V68M/L97Q, Q33L/E35D/M47L/V68M/L85Q/E88D, Q33L/E35D/M43V/M47I/A71G, E35D/M47L/A71G/L97Q, E35D/M47V/A71G/L85M/L97Q, H18Y/Y31H/E35D/M47V/A71G/L85Q, E35D/D46E/M47V/L97Q, E35D/D46V/M47I/A71G/F92V, E35D/M47V/T62A/A71G/V83A/Y87H/L97M, Q33L/E35D/N48K/L85Q/L97Q, E35D/L85Q/K93T/E95V/L97Q, E35D/M47V/N48K/V68M/K89N, Q33L/E35D/M47I/N48D/A71G, R29H/E35D/M43V/M47I/I49V, Q27H/E35D/M47I/L85Q/D90G, E35D/M47I/L85Q/D90G, E35D/M47I/T62S/L85Q, A26E/E35D/M47L/A71G, E35D/M47I/Y87Q/K89E, V22A/E35D/M47I/Y87N, H18Y/A26E/E35D/M47L/L85Q/D90G, E35D/M47L/A71G/L85Q, E35D/M47V/A71G/E88D, E35D/A71G, E35D/M47V/A71G, I30V/E35D/M47V/A71G/A91V, 130V/Y31C/E35D/M47V/A71G/L85M, V22D/E35D/M47L/L85Q, H18Y/E35D/N48K, E35D/T41S/M47V/A71G/K89N, E35D/M47V/N48T/L85Q, E35D/D46E/M47V/A71D/D90G, E35D/D46E/M47V/A71D, E35D/T41S/M431/A71G/D90G, E35D/T41S/M431/M47V/A71G, E35D/T41S/M43I/M47L/A71G, H18Y/V22A/E35D/M47V/T62S/A71G, H18Y/A26E/E35D/M47L/V68M/A71G/D90G, E35D/K37E/M47V/N48D/L85Q/D90N, Q27H/E35D/D46V/M47L/A71G, V22L/Q27H/E35D/M47I/A71G, E35D/D46V/M47L/V68M/L85Q/E88D, E35D/T41S/M43V/M47I/L70M/A71G, E35D/D46E/M47V/N63D/L85Q, E35D/M47V/T62A/A71D/K93E, E35D/D46E/M47V/V68M/D90G/K93E, E35D/M43I/M47V/K89N, E35D/M47L/A71G/L85M/F92Y, E35D/M42V/M47V/E52D/L85Q, V22D/E35D/M47L/L70M/L97Q, E35D/T41S/M47V/L97Q, E35D/Y53H/A71G/D90G/L97R, E35D/A71D/L72V/R73H/E81K, Q33L/E35D/M43I/Y53F/T62S/L85Q, E35D/M38T/D46E/M47V/N48S, Q33R/E35D/M47V/N48K/L85M/F92L, E35D/M38T/M43V/M47V/N48R/L85Q, T28Y/Q33H/E35D/D46V/M47I/A71G, E35D/N48K/L72V, E35D/T41S/N48T, D46V/M47I/A71G, M47I/A71G, E35D/M43I/M47L/L85M, E35D/M43I/D46E/A71G/L85M, H18Y/E35D/M47L/A71G/A91S, E35D/M47I/N48K/I61F, E35D/M47V/T62S/L85Q, M43I/M47L/A71G, E35D/M47V, E35D/M47L/A71G/L85M, V22A/E35D/M47L/A71G, E35D/M47L/A71G, E35D/D46E/M47I, Q27H/E35D/M47I, E35D/D46E/L85M, E35D/D46E/A91G, E35D/D46E, E35D/L97R, H18Y/E35D, Q27L/E35D/M47V/I61V/L85M, E35D/M47V/I61V/L85M, E35D/M47V/L85M/R94Q, E35D/M47V/N48K/L85M, H18Y/E35D/M47V/N48K, A26E/Q27R/E35D/M47L/N48Y/L85Q, E35D/D46E/M47L/V68M/L85Q/F92L, E35D/M47I/T62S/L85Q/E88D, E24D/Q27R/E35D/T41S/

M47V/L85Q, S15T/H18Y/E35D/M47V/T62A/N64S/A71G/L85Q/D90N, E35D/M47L/V68M/A71G/L85Q/D90G, H18Y/E35D/M47I/V68M/A71G/R94L, Q33R/M47V/T62N/A71G, H18Y/V22A/E35D/T41S/M47V/T62N/A71G/A91G, E35D/M47L/L70M, E35D/M47L/V68M, E35D/D46V/M47L/V68M/E88D, E35D/D46V/M47L/V68M/D90G, E35D/D46V/M47L/V68M/K89N, E35D/D46V/M47L/V68M/L85Q, E35D/D46V/M47L/V68M, E35D/D46V/M47L/V70M, E35D/D46V/M47L/V70M/L85Q, E35D/M47V/N48K/V68M, E24D/E35D/M47L/V68M/E95V/L97Q, E35D/D46E/M47I/T62A/V68M/L85M/Y87C, E35D/D46E/M47I/V68M/L85M, E35D/D46E/M47L/V68M/A71G/Y87C/K93R, E35D/D46E/M47L/V68M/T79M/L85M, E35D/D46E/M47L/V68M/T79M/L85M/L97Q, E35D/D46E/M47V/V68M/L85Q, E35D/M43I/M47L/V68M, E35D/M47I/V68M/Y87N, E35D/M47L/V68M/E95V/L97Q, E35D/M47L/Y53F/V68M/A71G/K93R/E95V, E35D/M47V/N48K/V68M/A71G/L85M, E35D/M47V/N48K/V68M/L85M, E35D/M47V/V68M/L85M, E35D/M47V/V68M/L85M/Y87D, E35D/T41S/D46E/M47I/V68M/K93R/E95V, H18Y/E35D/D46E/M47I/V68M/R94L, H18Y/E35D/M38I/M47L/V68M/L85M, H18Y/E35D/M47I/V68M/Y87N, H18Y/E35D/M47L/V68M/A71G/L85M, H18Y/E35D/M47L/V68M/E95V/L97Q, H18Y/E35D/M47L/Y53F/V68M/A71G, H18Y/E35D/M47L/Y53F/V68M/A71G/K93R/E95V, H18Y/E35D/M47V/V68M/L85M, H18Y/E35D/V68M/A71G/R94Q/E95V, H18Y/E35D/V68M/L85M/R94Q, H18Y/E35D/V68M/T79M/L85M, H18Y/V22D/E35D/M47V/N48K/V68M, Q27L/Q33L/E35D/T41S/M47V/N48K/V68M/L85M, Q33L/E35D/M47V/T62S/V68M/L85M, Q33R/E35D/M38I/M47L/V68M, R29C/E35D/M47L/V68M/A71G/L85M, S21P/E35D/K37E/D46E/M47I/V68M, S21P/E35D/K37E/D46E/M47I/V68M/R94L, T13R/E35D/M47L/V68M, T13R/H18Y/E35D/V68M/L85M/R94Q, T13R/Q27L/Q33L/E35D/T41S/M47V/N48K/V68M/L85M, T13R/Q33L/E35D/M47L/V68M/L85M, T13R/Q33L/E35D/M47V/T62S/V68M/L85M, T13R/Q33R/E35D/M38I/M47L/V68M, T13R/Q33R/E35D/M38I/M47L/V68M/E95V/L97Q, T13R/Q33R/E35D/M381/M47L/V68M/L85M, T13R/Q33R/E35D/M381/M47L/V68M/L85M/R94Q, T13R/Q33R/E35D/M47L/V68M, T13R/Q33R/E35D/M47L/V68M/L85M, V22D/E24D/E35D/M47L/V68M, V22D/E24D/E35D/M47L/V68M/L85M/D90G, V22D/E24D/E35D/M47V/V68M, E35D/D46V, E35D/V68M, E35D/L85Q, D46V/M47L, D46V/V68M, D46V/L85Q, M47L/V68M, M47L/L85Q, V68M/L85Q, E35D/D46V/M47L, E35D/D46V/V68M, E35D/D46V/L85Q, E35D/V68M/L85Q, D46V/M47L/V68M, D46V/M47L/L85Q, D46V/V68M/L85Q, M47L/V68M/L85Q, E35D/D46V/M47L/L85Q, E35D/D46V/V68M/L85Q, E35D/M47L/V68M/L85Q, D46V/M47L/V68M/L85Q, E35D/N48K, E35D/K89N, M47V/N48K, M47V/V68M, M47V/K89N, N48K/V68M, N48K/K89N, E35D/M47V/N48K, E35D/M47V/V68M, E35D/M47V/K89N, E35D/N48K/V68M, E35D/N48K/K89N, E35D/V68M/K89N, M47V/N48K/V68M, M47V/N48K/K89N, M47V/V68M/K89N, N48K/V68M/K89N, E35D/M47V/N48K/K89N, E35D/M47V/V68M/K89N, E35D/N48K/V68M/K89N, M47V/N48K/V68M/K89N, E35D/D46V/M47V/N48K/V68M, E35D/D46V/M47V/V68M/L85Q, E35D/D46V/M47V/V68M/K89N, E35D/M47V/N48K/V68M/L85Q, E35D/M47V/V68M/L85Q/K89N, A26E/E35D/M47L/V68M/A71G/D90G, H18Y/E35D/M47L/V68M/A71G/D90G, H18Y/A26E/M47L/V68M/A71G/D90G, H18Y/A26E/E35D/V68M/A71G/D90G, H18Y/A26E/E35D/M47L/A71G/D90G, H18Y/A26E/E35D/M47L/V68M/D90G, H18Y/A26E/E35D/M47L/V68M/A71G, E35D/M47L/V68M/A71G/D90G, H18Y/M47L/V68M/A71G/D90G, H18Y/A26E/V68M/A71G/D90G, H18Y/A26E/E35D/A71G/D90G, H18Y/A26E/E35D/M47L/D90G, H18Y/A26E/E35D/M47L/V68M, A26E/M47L/V68M/A71G/D90G, A26E/E35D/V68M/A71G/D90G, A26E/E35D/M47L/A71G/D90G, A26E/E35D/M47L/V68M/D90G, A26E/E35D/M47L/V68M/A71G, H18Y/E35D/V68M/A71G/D90G, H18Y/E35D/M47L/A71G/D90G, H18Y/E35D/M47L/V68M/D90G, H18Y/E35D/M47L/V68M/A71G, H18Y/A26E/M47L/A71G/D90G, H18Y/A26E/M47L/V68M/D90G, H18Y/A26E/M47L/V68M/A71G, H18Y/A26E/E35D/V68M/D90G, H18Y/A26E/E35D/V68M/A71G, H18Y/A26E/E35D/M47L/A71G, M47L/V68M/A71G/D90G, H18Y/V68M/A71G/D90G, H18Y/A26E/A71G/D90G, H18Y/A26E/E35D/D90G, H18Y/A26E/E35D/M47L, E35D/V68M/A71G/D90G, E35D/M47L/A71G/D90G, E35D/M47L/V68M/D90G, E35D/M47L/V68M/A71G, A26E/V68M/A71G/D90G, A26E/M47L/A71G/D90G, A26E/M47L/V68M/D90G, A26E/M47L/V68M/A71G, A26E/E35D/A71G/D90G, A26E/E35D/V68M/D90G, A26E/E35D/V68M/A71G, A26E/E35D/M47L/D90G, A26E/E35D/M47L/V68M, H18Y/M47L/A71G/D90G, H18Y/M47L/V68M/D90G, H18Y/M47L/V68M/A71G, H18Y/E35D/A71G/D90G, H18Y/E35D/V68M/D90G, H18Y/E35D/V68M/A71G, H18Y/E35D/M47L/D90G, H18Y/E35D/M47L/A71G, H18Y/E35D/M47L/V68M, H18Y/A26E/V68M/D90G, H18Y/A26E/V68M/A71G, H18Y/A26E/M47L/D90G, H18Y/A26E/M47L/A71G, H18Y/A26E/M47L/V68M, H18Y/A26E/E35D/A71G, H18Y/A26E/E35D/V68M, H18Y/E35D/M47V/V68M/A71G, H18C/A26P/E35D/M47L/V68M/A71G, H18I/A26P/E35D/M47V/V68M/A71G, H18L/A26N/D46E/V68M/A71G/D90G, H18L/E35D/M47V/V68M/A71G/D90G, H18T/A26N/E35D/M47L/V68M/A71G, H18V/A26K/E35D/M47L/V68M/A71G, H18V/A26N/E35D/M47V/V68M/A71G, H18V/A26P/E35D/M47V/V68L/A71G, H18V/A26P/E35D/M47L/V68M/A71G, H18V/E35D/M47V/V68M/A71G/D90G, H18Y/A26P/E35D/M47I/V68M/A71G, H18Y/A26P/E35D/M47V/V68M/A71G, H18Y/E35D/M47V/V68L/A71G/D90G, H18Y/E35D/M47V/V68M/A71G/D90G, A26P/E35D/M47I/V68M/A71G/D90G, H18V/A26G/E35D/M47V/V68M/A71G/D90G, H18V/A26S/E35D/M47L/V68M/A71G/D90G, H18V/A26R/E35D/M47L/V68M/A71G/D90G, H18V/A26D/E35D/M47V/V68M/A71G/D90G, H18V/A26Q/E35D/M47V/V68L/A71G/D90G, H18A/A26P/E35D/M47L/V68M/A71G/D90G, H18A/A26N/E35D/M47L/V68M/A71G/D90G, H18F/A26P/E35D/M47I/V68M/A71G/D90G, H18F/A26H/E35D/M47L/V68M/A71G/D90G, H18F/A26N/E35D/M47V/V68M/A71G/D90K, H18Y/A26N/E35D/M47F/V68M/A71G/D90G, H18Y/A26P/E35D/M47Y/V68I/A71G/D90G, H18Y/A26Q/E35D/M47T/V68M/A71G/D90G, H18R/A26P/E35D/D46N/M47V/V68M/A71G/D90P, and H18F/A26D/E35D/D46E/M47T/V68M/A7IG/D90G, where the position(s) of the amino acid substitution(s) correspond(s) to the positions of CD80 set forth in SEQ ID NO: 2.

8. The variant CD80 polypeptide of embodiment 6 or embodiment 7, wherein:

the one or more amino acid modifications is selected from among V20I, V22I, V22L, A26E, Q27H, Q33L, Q33R, E35D, E35G, T41S, M43L, D46E, D46V, M47I, M47L, M47V, N55D, T57I, 161V, L70M, A71D, A71G, L72V, L85M, L85Q, R94W, and L97Q;

optionally wherein the one or more amino acid modification is selected from among V20I, V22L, A26E, Q27H, Q33L, Q33R, E35D, E35G, M47I, D46E, D46V, M47L, M47V, T57I, L70M, A71D, A71G, L72V, L85M, L85Q, and L97Q;

optionally wherein the one or more amino acid modification is selected from A26E, Q33L, E35D, M47I, M47L, M47V, T57I, L70M, A71D, A71G, and L85Q;

optionally wherein the one or more amino acid modification is selected from A26E, E35D, D46V, M47L, M47V, L70M, A71G, and L85Q.

where the position(s) of the amino acid substitution(s) correspond(s) to the positions of CD80 set forth in SEQ ID NO: 2.

9. The variant CD80 polypeptide of any of embodiments 6-8, wherein:

the one or more amino acid modification comprises A26E;

the one or more amino acid modification comprises E35D;

the one or more amino acid modification comprises D46V;

the one or more amino acid modification comprise M47L;

the one or more amino acid modification comprise M47V; and/or the one or more amino acid modification comprise A71G, where the position(s) of the amino acid modification(s) correspond(s) to the numbering of positions of CD80 set forth in SEQ ID NO: 2.

10. The variant CD80 polypeptide of any of embodiments 6-9, wherein the amino acid modifications are selected from E35D/D46E, E35D/D46V, E35D/M47I, E35D/M47L, E35D/M47V, E35D/V68M, E35D/A71G, E35D/D90G; D46E/M47I, D46E/M47L, D46E/M47V, D46E/V68M, D46E/A71G or D46E/D90G; M47I/V68M, M47I/A71G, M48I/D90G; M47L/V68M, M47L/A71G, M47L/D90G; M47V/V68M, M47V/A71G, M47V/D90G; V68M/A71G or V68M/D90G, A71G/D90G, optionally wherein the amino acid modifications are E35D/M47I/V68M, E35D/M47L/V68M, E35D/M47V/V68M, wherein the position(s) of the amino acid modification(s) correspond(s) to the numbering of positions of CD80 set forth in SEQ ID NO: 2

11. A variant CD80 polypeptide, comprising an IgV domain or a specific binding fragment thereof, an IgC domain or a specific binding fragment thereof, or both, wherein the variant CD80 polypeptide comprises one or more the amino acid substitutions, the one or more amino acid substitutions comprising at least the amino acid substitution L70P but not comprising the amino acid substitutions V68M, L72P and/or K86E, where the position(s) of the amino acid modification (s) correspond(s) to the positions of CD80 set forth in SEQ ID NO: 2.

12. The variant CD80 polypeptide of embodiment 11, wherein the one or more amino acid modification is selected from among: L70P, I30F/L70P, I30V/T57I/L70P/A71D/A91T, N55D/L70P/E77G, and L70P/F92S.

13. The variant CD80 polypeptide of any of embodiments 1-12, wherein the unmodified CD80 is a mammalian CD80.

14. The variant CD80 polypeptide of any of embodiments 1-13, wherein the CD80 is a human CD80.

15. The variant CD80 polypeptide of any of embodiments 1-14, wherein the variant CD80 polypeptide comprises:

the IgV domain or a specific binding fragment thereof; and the IgC domain or a specific binding fragment thereof.

16. The variant CD80 polypeptide of any of embodiments 1-15, wherein the unmodified CD80 comprises (i) the sequence of amino acids set forth in SEQ ID NO:2, (ii) a sequence of amino acids that has at least 95% sequence identity to SEQ ID NO:2; or (iii) is a portion thereof comprising an IgV domain or IgC domain or specific binding fragments thereof.

17. The variant CD80 polypeptide of any of embodiments 1-15, wherein:

the specific binding fragment of the IgV domain or the IgC domain has a length of at least 50, 60, 70, 80, 90, 100, 110 or more amino acids;

the specific binding fragment of the IgV domain comprises a length that is at least 80% of the length of the IgV domain set forth as amino acids 35-135, 35-138, 37-138 or 35-141 of SEQ ID NO:1; or the specific binding fragment of the IgC domain comprises a length that is at least 80% of the length of the IgC domain set forth as amino acids 145-230, 154-232 or 142-232 of SEQ ID NO:1.

18. The variant CD80 polypeptide of any of embodiments 1-17, wherein the variant CD80 polypeptide comprises up to 1, 2, 3, 4, 5, 6, 7, 8, 9, 10, 11, 12, 13, 14, 15, 16, 17, 18, 19 or 20 amino acid modifications, optionally amino acid substitutions, insertions and/or deletions.

19. The variant CD80 polypeptide of any of embodiments 1-18, wherein the variant CD80 polypeptide comprises a sequence of amino acids that exhibits at least 85%, 86%, 87%, 88%, 89%, 90%, 91%, 92%, 93%, 94%, 95%, 96%, 97%, 98% or 99% sequence identity to SEQ ID NO: 2, or a specific binding fragment thereof.

20. The variant CD80 polypeptide of any of embodiments 1-19, wherein the variant CD80 polypeptide comprises the IgV domain or a specific fragment thereof and the IgC domain or a specific fragment thereof.

21. The variant CD80 polypeptide of any of embodiments 1-20, comprising or consisting of the sequence of amino acids set forth in any of SEQ ID NOS: 3-75, 2009-2104, 2297-2507, and 2930-2960 or a specific binding fragment thereof, or a sequence of amino acids that exhibits at least 95% sequence identity to any of SEQ ID NOS: 3-75, 2009-2104, 2297-2507, and 2930-2960 or a specific binding fragment thereof and that contains the one or more of the amino acid modifications thereof.

22. The variant CD80 polypeptide of any of embodiments 1-19, wherein the variant CD80 polypeptide comprises the IgV domain or a specific binding fragment thereof.

23. The variant CD80 polypeptide of any of embodiments 1-19 and 22, wherein the IgV domain or specific binding fragment thereof is the only CD80 portion of the variant CD80 polypeptide.

24. The variant CD80 polypeptide of any of embodiments 1-19, 22 and 23, comprising or consisting of the sequence of amino acids set forth in any of SEQ ID NOS: 77-149, 151-223, 2105-2296, 2508-2929, and 2961-3022 or a specific binding fragment thereof, a sequence of amino acids that exhibits at least 95% sequence identity to any of SEQ ID NOS: 77-149, 151-223, 2105-2296, 2508-2929, and 2961-3022 or a specific binding fragment thereof and that contains the one or more of the amino acid modifications thereof.

25. The variant CD80 polypeptide of any of embodiments 1-19, wherein the IgC domain or specific binding fragment thereof is the only CD80 portion of the variant CD80 polypeptide.

26. The variant CD80 polypeptide of any of embodiments 1-25, wherein the variant CD80 polypeptide exhibits altered binding to the ectodomain of CTLA-4, PD-L1 and/or CD28 compared to the binding of the unmodified CD80 for the ectodomain.

27. The variant CD80 polypeptide of embodiment 26, wherein the altered binding is altered binding affinity and/or altered binding selectivity.

28. The variant CD80 polypeptide of embodiment 26 or embodiment 27, wherein the CTLA-4 is a human CTLA-4.

29. The variant CD80 polypeptide of any of embodiments 26-28, wherein the CD28 is a human CD28.

30. The variant CD80 polypeptide of any of embodiments 26-29, wherein the PD-L1 is a human PD-L1.

31. The variant CD80 polypeptide of any of embodiments 1-30, wherein the variant CD80 exhibits increased binding affinity to the ectodomain of CTLA4 compared to the binding affinity of the unmodified CD80 for the ectodomain of CTLA4.

32. The variant CD80 polypeptide of any of embodiments 1-31 wherein the CD80 polypeptide comprises one or more amino acid modifications in an unmodified CD80 or specific binding fragment thereof, corresponding to position(s) 7, 23, 26, 30, 35, 46, 57, 58, 71, 73, 79, and/or 84, with reference to numbering of SEQ ID NO: 2

33. The variant CD80 polypeptide of any of embodiments 1-31, wherein the CD80 polypeptide comprises one or more amino acid modifications in an unmodified CD80 or specific binding fragment thereof, selected from among E7D, T13A, T13R, S15T, C16R, H18A, H18C, H18F, H18I, H18T, H18V, V20I, V22D, V22L, E23D, E23G, E24D, A26D, A26E, A26G, A26H, A26K, A26N, A26P, A26Q, A26R, A26S, A26T, Q27H, Q27L, I30V, Q33L, Q33R, E35D, E35G, T41S, M42V, M43L, M43T, D46E, D46N, D46V, M47I, M47L, M47V, M47Y, N48D, N48H, N48K, N48R, N48S, N48T, N48Y, Y53F, K54E, K54R, T57A, T57, I58V, I61F, I61V, T62A, T62N, I67L, V68E, V68I, V68L, I69F, L70M, A71D, A71G, L72V, R73H, P74S, T79I, T79M, E81G, E81K, V84I, L85M, L85Q, Y87C, Y87D, E88V, D90P, F92V, R94Q, R94W, E95D, E95V, and L97Q, wherein the position(s) of the amino acid modifications(s) correspond(s) to the positions of CD80 set forth in SEQ ID NO: 2.

34. The variant CD80 polypeptide of any of embodiments 1-33, wherein the one or more amino acid modification is selected from among: Q27H/T41S/A71D, T13R/C16R/L70Q/A71D, T57I, V22L/M38V/M47T/A71D/L85M, S44P/I67T/P74S/E81G/E95D, A71D, T13A/I61N/A71D, E35D/M47I, M47V/N48H, V20I/M47V/T57I/V84I, V20I/M47V/A71D, A71D/L72V/E95K, V22L/E35G/A71D/L72P, E35D/A71D, E35D/I67L/A71D, Q27H/E35G/A71D/L72P/T79I, T13R/M42V/M47I/A71D, E35D, E35D/M47I/L70M, E35D/A71D/L72V, E35D/M43L/L70M, A26P/E35D/M43I/L85Q/E88D, E35D/D46V/L85Q, Q27L/E35D/M47I/T57I/L70Q/E88D, M47V/I69F/A71D/V83I, E35D/T57A/A71D/L85Q, H18Y/A26T/E35D/A71D/L85Q, E35D/M47L, E23D/M42V/M43I/I58V/L70R, V68M/L70M/A71D/E95K, E35D/M43I/A71D, T41S/T57I/L70R, H18Y/A71D/L72P/E88V, V20I/A71D, E23G/A26S/E35D/T62N/A71D/L72V/L85M, A12T/E24D/E35D/D46V/I61V/L72P/E95V, E35G/K54E/A71D/L72P, L70Q/A71D, A26E/E35D/M47L/L85Q, D46E/A71D, E35D/M47L/L85Q, H18Y/E35D/M47L, A26E/E35D/M43T/M47L/L85Q/R94Q, E24D/Q33L/E35D/M47V/K54R/L85Q, E7D/E35D/M47I/L97Q, H18L/V22A/E35D/M47L/N48T/L85Q, Q27H/E35D/M47L/L85Q/R94Q/E95K, E35D/M47I/E77A/L85Q/R94W, V22A/E35D/V68E/A71D, E35D/M47L/A71G/L97Q, E35D/M47V/A71G/L85M/L97Q, E35D/D46E/M47V/L97Q, E35D/D46V/M47I/A71G/F92V, E35D/L85Q/K93T/E95V/L97Q, Q27H/E35D/M47I/L85Q/D90G, E35D/M47I/L85Q/D90G, E35D/M47I/T62S/L85Q, A26E/E35D/M47L/A71G, V22A/E35D/M47I/Y87N, H18Y/A26E/E35D/M47L/L85Q/D90G, E35D/M47V/A71G/E88D, E35D/A71G, E35D/M47V/A71G, I30V/E35D/M47V/A71G/A91V, V22D/E35D/M47L/L85Q, H18Y/E35D/N48K, E35D/T41S/M47V/A71G/K89N, E35D/M47V/N48T/L85Q, E35D/D46E/M47V/A71D/D90G, E35D/D46E/M47V/A71D, E35D/T41S/M43I/A71G/D90G, E35D/T41S/M43I/M47V/A71G, E35D/T41S/M43I/M47L/A71G, H18Y/V22A/E35D/M47V/T62S/A71G, H18Y/A26E/E35D/M47L/V68M/A71G/D90G, E35D/K37E/M47V/N48D/L85Q/D90N, E35D/D46V/M47L/V68M/L85Q/E88D, E35D/T41S/M43V/M47I/L70M/A71G, E35D/D46E/M47V/N63D/L85Q, E35D/M47V/T62A/A71D/K93E, E35D/D46E/M47V/V68M/D90G/K93E, E35D/M43I/M47V/K89N, E35D/M47L/A71G/L85M/F92Y, E35D/M42V/M47V/E52D/L85Q, E35D/T41S/M47V/L97Q, E35D/Y53H/A71G/D90G/L97R, E35D/A71D/L72V/R73H/E81K, E35D/M38T/D46E/M47V/N48S, E35D/M38T/M43V/M47V/N48R/L85Q, E35D/N48K/L72V, E35D/T41S/N48T, D46V/M47I/A71G, M47I/A71G, E35D/M43I/M47L/L85M, E35D/M43I/D46E/A71G/L85M, H18Y/E35D/M47L/A71G/A91S, E35D/M47I/N48K/I61F, E35D/M47V/T62S/L85Q, M43I/M47L/A71G, E35D/M47V, E35D/M47L/A71G/L85M, V22A/E35D/M47L/A71G, E35D/M47L/A71G, E35D/D46E/M47I, Q27H/E35D/M47I, E35D/D46E/L85M, E35D/D46E/A91G, E35D/D46E, E35D/L97R, H18Y/E35D, Q27L/E35D/M47V/I61V/L85M, E35D/M47V/I61V/L85M, E35D/M47V/L85M/R94Q, E35D/M47V/N48K/L85M, H18Y/E35D/M47V/N48K, A26E/Q27R/E35D/M47L/N48Y/L85Q, E35D/M47I/T62S/L85Q/E88D, E24D/Q27R/E35D/T41S/M47V/L85Q, S15T/H18Y/E35D/M47V/T62A/N64S/A71G/L85Q/D90N, E35D/M47L/V68M/A71G/L85Q/D90G, H18Y/E35D/M47I/V68M/A71G/R94L, H18Y/V22A/E35D/T41S/M47V/T62N/A71G/A91G, E24D/E35D/M47L/V68M/E95V/L97Q, E35D/D46E/M47I/T62A/V68M/L85M/Y87C, E35D/D46E/M47I/V68M/L85M, E35D/D46E/M47L/V68M/A71G/Y87C/K93R, E35D/D46E/M47L/V68M/T79M/L85M, E35D/D46E/M47V/V68M/L85Q, E35D/M43I/M47L/V68M, E35D/M47I/V68M/Y87N, E35D/M47L/V68M/E95V/L97Q, E35D/M47L/Y53F/V68M/A71G/K93R/E95V, E35D/M47V/N48K/V68M/A71G/L85M, E35D/M47V/N48K/V68M/L85M, E35D/M47V/V68M/L85M, E35D/M47V/V68M/L85M/Y87D, E35D/T41S/D46E/M47I/V68M/K93R/E95V, H18Y/E35D/D46E/M47I/V68M/R94L, H18Y/E35D/D46E/M47I/V68M/R94L, H18Y/E35D/M47I/V68M/Y87N, H18Y/E35D/M47I/V68M/Y87N, H18Y/E35D/M47L/V68M/A71G/L85M, H18Y/E35D/M47L/V68M/A71G/L85M, H18Y/E35D/M47L/V68M/E95V/L97Q, H18Y/E35D/M47L/V68M/E95V/L97Q, H18Y/E35D/M47L/Y53F/V68M/A71G, H18Y/E35D/M47L/Y53F/V68M/A71G/K93R/E95V, H18Y/E35D/M47V/V68M/L85M, H18Y/E35D/V68M/A71G/R94Q/E95V, H18Y/E35D/V68M/L85M/R94Q, H18Y/E35D/V68M/T79M/L85M, H18Y/V22D/E35D/M47V/N48K/V68M, S21P/E35D/K37E/D46E/M47I/V68M, S21P/E35D/K37E/D46E/M47I/V68M/R94L, T13R/E35D/M47L/V68M, T13R/Q33R/E35D/M381/M47L/V68M/E95V/L97Q, T13R/Q33R/E35D/M381/M47L/V68M/L85M, T13R/Q33R/E35D/M381/M47L/V68M/L85M/R94Q, T13R/Q33R/E35D/M47L/V68M, T13R/Q33R/E35D/M47L/V68M/L85M, V22D/E24D/E35D/M47L/V68M, V22D/E24D/E35D/M47L/V68M/L85M/D90G, V22D/E24D/E35D/M47V/V68M, H18Y/E35D/M47V/V68M/A71G, H18C/A26P/E35D/M47L/V68M/A71G, H18I/A26P/E35D/M47V/V68M/A71G, H18L/A26N/D46E/V68M/A71G/D90G, H18L/E35D/M47V/V68M/A71G/D90G, H18T/A26N/E35D/M47L/V68M/A71G, H18V/A26K/E35D/M47L/V68M/A71G, H18V/A26N/E35D/M47V/V68M/A71G, H18V/A26P/E35D/M47V/V68L/A71G, H18V/A26P/E35D/M47L/V68M/A71G, H18V/E35D/M47V/V68M/A71G/D90G, H18Y/A26P/E35D/M47I/V68M/A71G, H18Y/A26P/E35D/M47V/V68M/A71G, H18Y/E35D/M47V/V68L/A71G/D90G, H18Y/E35D/M47V/V68M/A71G/D90G, A26P/E35D/M47I/V68M/A71G/D90G, H18V/A26G/E35D/M47V/V68M/A71G/D90G, H18V/A26S/E35D/M47L/V68M/A71G/D90G, H18V/A26R/E35D/M47L/V68M/A71G/D90G, H18V/A26D/E35D/M47V/V68M/A71G/D90G, H18V/A26Q/E35D/M47V/V68L/A71G/D90G, H18A/A26P/E35D/M47L/V68M/A71G/D90G, H18A/A26N/E35D/M47L/V68M/A71G/D90G, H18F/A26P/E35D/M47I/V68M/A71G/D90G, H18F/A26H/E35D/M47L/V68M/A71G/D90G, H18F/A26N/E35D/M47V/V68M/A71G/D90K, H18Y/A26N/E35D/M47F/V68M/A71G/D90G, H18Y/A26P/E35D/M47Y/V68I/A71G/D90G, H18Y/A26Q/E35D/M47T/V68M/A71G/D90G, H18R/A26P/E35D/D46N/M47V/V68M/A71G/D90P, and H18F/A26D/E35D/D46E/M47T/V68M/A71G/D90G where the position(s) of the amino acid substitution(s) correspond(s) to the positions of CD80 set forth in SEQ ID NO: 2.

35. The variant CD80 polypeptide of any of embodiments 31-34, wherein the increased affinity to the ectodomain of CTLA-4 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to binding affinity of the unmodified CD80 for the ectodomain of CTLA-4.

36. The variant CD80 polypeptide of any of embodiments 1-35, wherein the variant polypeptide specifically binds to the ectodomain of CTLA-4 with increased selectivity compared to the unmodified CD80 for the ectodomain of CTLA-4.

37. The variant CD80 polypeptide of embodiment 36, wherein the increased selectivity comprises a greater ratio of binding of the variant polypeptide for CTLA-4 versus CD28 compared to the ratio of binding of the unmodified CD80 polypeptide for CTLA-4 versus CD28.

38. The variant CD80 polypeptide of embodiment 37, wherein the ratio is greater by at least or at least about 1.5-fold, 2.0-fold, 3.0-fold, 4.0-fold, 5-fold, 10-fold, 15-fold, 20-fold, 30-fold, 40-fold, 50-fold or more.

39. The variant CD80 polypeptide of any of embodiments 1-31, wherein the variant CD80 exhibits increased binding affinity to the ectodomain of CD28 compared to the binding affinity of the unmodified CD80 for the ectodomain of CD28.

40. The variant CD80 polypeptide of any of embodiments 1-31 and 39 wherein the CD80 polypeptide comprises one or more amino acid modifications in an unmodified CD80 or specific binding fragment thereof, corresponding to position(s) 23, 26, 35, 46, 55, 57, 58, 71, 79, and/or 84, with reference to numbering of SEQ ID NO: 2

41. The variant CD80 polypeptide of any of embodiments 1-31, 39 and 40, wherein the CD80 polypeptide comprises one or more amino acid modifications in an unmodified CD80 or specific binding fragment thereof, selected from among T13R, S15T, H18A, H18C, H18F, H18I, H18T, H18V, V20I, V22D, V22L, E23D, E23G, E24D, A26D, A26E, A26G, A26H, A26K, A26N, A26P, A26Q, A26R, A26S, A26T, Q27H, Q27L, Q33R, E35D, E35G, T41S, M42V, M43L, D46E, D46N, D46V, M47I, M47L, M47V, M47Y, N48K, N48Y, Y53F, K54E, N55I, T57A, T57I, 158V, I61F, I61V, T62A, T62N, I67L, V68E, V68I, V68L, I69F, L70M, A71D, A71G, L72V, T79I, T79M, V84I, L85M, L85Q, Y87C, Y87D, E88V, D90P, R94Q, R94W, E95V, and L97Q, where the position(s) of the amino acid substitution(s) correspond(s) to the positions of CD80 set forth in SEQ ID NO: 2.

42. The variant CD80 polypeptide of any of embodiments 1-31 and 39-41, wherein the one or more amino acid modification is selected from among: Q27H/T41S/A71D, V20I/M47V/T57I/V84I, V20I/M47V/A71D, A71D/L72V/E95K, V22L/E35G/A71D/L72P, E35D/A71D, E35D/I67L/A71D, Q27H/E35G/A71D/L72P/T79I, T13R/M42V/M47I/A71D, E35D, E35D/M47I/L70M, E35D/A71D/L72V, E35D/M43L/L70M, A26P/E35D/M43I/L85Q/E88D, E35D/D46V/L85Q, Q27L/E35D/M47I/T57I/L70Q/E88D, M47V/I69F/A71D/V83I, E35D/T57A/A71D/L85Q, H18Y/A26T/E35D/A71D/L85Q, E35D/M47L, E23D/M42V/M43I/I58V/L70R, V68M/L70M/A71D/E95K, N55I/T57I/I69F, E35D/M43I/A71D, T41S/T57I/L70R, H18Y/A71D/L72P/E88V, V20I/A71D, E23G/A26S/E35D/T62N/A71D/L72V/L85M, A12T/E24D/E35D/D46V/I61V/L72P/E95V, E35G/K54E/A71D/L72P, L70Q/A71D, A26E/E35D/M47L/L85Q, D46E/A71D, Y31H/E35D/T41S/V68L/K93R/R94W, V22A/E35D/V68E/A71D, E35D/D46E/M47V/V68M/D90G/K93E, E35D/N48K/L72V, D46V/M47I/A71G, M47I/A71G, E35D/M43I/M47L/L85M, E35D/M43I/D46E/A71G/L85M, H18Y/E35D/M47L/A71G/A91S, E35D/M47I/N48K/I61F, E35D/M47V/T62S/L85Q, M43I/M47L/A71G, E35D/M47V, E35D/M47L/A71G/L85M, V22A/E35D/M47L/A71G, E35D/M47L/A71G, E35D/D46E/M47I, Q27H/E35D/M47I, E35D/D46E/L85M, E35D/D46E/A91G, E35D/D46E, H18Y/E35D, Q27L/E35D/M47V/I61V/L85M, E35D/M47V/I61V/L85M, E35D/M47V/N48K/L85M, H18Y/E35D/M47V/N48K, A26E/Q27R/E35D/M47L/N48Y/L85Q, E35D/M47I/T62S/L85Q/E88D, E24D/Q27R/E35D/T41S/M47V/L85Q, S15T/H18Y/E35D/M47V/T62A/N64S/A71G/L85Q/D90N, E35D/M47L/V68M/A71G/L85Q/D90G, H18Y/E35D/M47I/V68M/A71G/R94L, H18Y/V22A/E35D/T41S/M47V/T62N/A71G/A91G, E35D/D46E/M47I/T62A/V68M/L85M/Y87C, E35D/D46E/M47I/V68M/L85M, E35D/D46E/M47L/V68M/A71G/Y87C/K93R, E35D/D46E/M47L/V68M/T79M/L85M, E35D/D46E/M47V/V68M/L85Q, E35D/M43I/M47L/V68M, E35D/M47I/V68M/Y87N, E35D/M47L/Y53F/V68M/A71G/K93R/E95V, E35D/M47V/N48K/V68M/A71G/L85M, E35D/M47V/N48K/V68M/L85M, E35D/M47V/V68M/L85M, E35D/M47V/V68M/L85M/Y87D, E35D/T41S/D46E/M47I/V68M/K93R/E95V, H18Y/E35D/D46E/M47I/V68M/R94L, H18Y/E35D/D46E/M47I/V68M/R94L, H18Y/E35D/M47I/V68M/Y87N, H18Y/E35D/M47I/V68M/Y87N, H18Y/E35D/M47L/V68M/A71G/L85M, H18Y/E35D/M47L/V68M/A71G/L85M, H18Y/E35D/M47L/V68M/E95V/L97Q, H18Y/E35D/M47L/Y53F/V68M/A71G, H18Y/E35D/M47L/Y53F/V68M/A71G/K93R/E95V, H18Y/E35D/M47L/Y53F/V68M/A71G/K93R/E95V, H18Y/E35D/M47V/V68M/L85M, H18Y/E35D/M47V/V68M/L85M, H18Y/E35D/V68M/A71G/R94Q/E95V, H18Y/E35D/V68M/L85M/R94Q, H18Y/E35D/V68M/T79M/L85M, H18Y/V22D/E35D/M47V/N48K/V68M, S21P/E35D/K37E/D46E/M47I/V68M, S21P/E35D/K37E/D46E/M47I/V68M/R94L, T13R/Q33R/E35D/M38I/M47L/V68M/E95V/L97Q, T13R/Q33R/E35D/M47L/V68M/L85M, V22D/E24D/E35D/M47L/V68M, V22D/

E24D/E35D/M47L/V68M/L85M/D90G, V22D/E24D/E35D/M47V/V68M, H18Y/E35D/M47V/V68M/A71G, H18C/A26P/E35D/M47L/V68M/A71G, H18I/A26P/E35D/M47V/V68M/A71G, H18L/A26N/D46E/V68M/A71G/D90G, H18L/E35D/M47V/V68M/A71G/D90G, H18T/A26N/E35D/M47L/V68M/A71G, H18V/A26K/E35D/M47L/V68M/A71G, H18V/A26N/E35D/M47V/V68M/A71G, H18V/A26P/E35D/M47V/V68L/A71G, H18V/A26P/E35D/M47L/V68M/A71G, H18V/E35D/M47V/V68M/A71G/D90G, H18Y/A26P/E35D/M47I/V68M/A71G, H18Y/A26P/E35D/M47V/V68M/A71G, H18Y/E35D/M47V/V68L/A71G/D90G, H18Y/E35D/M47V/V68M/A71G/D90G, A26P/E35D/M47I/V68M/A71G/D90G, H18V/A26G/E35D/M47V/V68M/A71G/D90G, H18V/A26S/E35D/M47L/V68M/A71G/D90G, H18V/A26R/E35D/M47L/V68M/A71G/D90G, H18V/A26D/E35D/M47V/V68M/A71G/D90G, H18V/A26Q/E35D/M47V/V68L/A71G/D90G, H18A/A26P/E35D/M47L/V68M/A71G/D90G, H18A/A26N/E35D/M47L/V68M/A71G/D90G, H18F/A26P/E35D/M47I/V68M/A71G/D90G, H18F/A26H/E35D/M47L/V68M/A71G/D90G, H18F/A26N/E35D/M47V/V68M/A71G/D90K, H18Y/A26P/E35D/M47Y/V68I/A71G/D90G, H18Y/A26Q/E35D/M47T/V68M/A71G/D90G, H18R/A26P/E35D/D46N/M47V/V68M/A71G/D90P, and H18F/A26D/E35D/D46E/M47T/V68M/A71G/D90G, where the position(s) of the amino acid substitution(s) correspond(s) to the positions of CD80 set forth in SEQ ID NO: 2.

43. The variant CD80 polypeptide of any of embodiments 39-42, wherein the increased affinity to the ectodomain of CD28 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100-fold, 150-fold, or 200-fold, compared to binding affinity of the unmodified CD80 for the ectodomain of CD28.

44. The variant CD80 polypeptide of any of embodiments 1-31, wherein the variant CD80 exhibits increased binding affinity to the ectodomain of PD-L1 compared to the binding affinity of the unmodified CD80 for the ectodomain of PD-L1.

45. The variant CD80 polypeptide of any of embodiments 1-31, and 44 wherein the CD80 polypeptide comprises one or more amino acid modifications in an unmodified CD80 or specific binding fragment thereof, corresponding to position(s) 7, 23, 26, 30, 34, 35, 46, 51, 55, 57, 58, 65, 71, 73, 78, 79, 82, and/or 84, with reference to numbering of SEQ ID NO: 2

46. The variant CD80 polypeptide of any of embodiments 1-31, and 44, wherein the CD80 polypeptide comprises one or more amino acid modifications in an unmodified CD80 or specific binding fragment thereof, selected from among E7D, T13A, T13R, S15T, C16R, H18A, H18C, H18F, H18I, H18T, H18V, V20A, V20I, V22D, V22I, V22L, E23D, E23G, E24D, L25S, A26D, A26E, A26G, A26H, A26K, A26N, A26P, A26Q, A26R, A26S, A26T, Q27H, Q27L, 130T, 130V, Q33E, Q33K, Q33L, Q33R, K34E, E35D, K36R, T41S, M421, M42V, M43L, M43T, D46E, D46N, D46V, M47F, M47I, M47L, M47V, N48D, N48H, N48K, N48R, N48S, N48T, N48Y, P51A, Y53F, K54R, N55D, N55I, T57I, 158V, I61F, I61V, T62A, T62N, L65P, I67L, V68I, V68L, I69F, L70M, A71D, A71G, L72V, R73S, P74S, D76H, G78A, T79A, T79I, T79L, T79M, T79P, E81G, E81K, C82R, V84A, V84I, L85E, L85M, L85Q, K86M, Y87C, Y87D, D90P, F92S, F92V, R94Q, R94W, E95D, E95V, L97M, and L97Q, where the position(s) of the amino acid substitution(s) correspond(s) to the positions of CD80 set forth in SEQ ID NO: 2.

47. The variant CD80 polypeptide of any of embodiments 1-31 and 44-46, wherein the one or more amino acid modification(s) is/are selected from among: Q27H/T41S/A71D, I30T/L70R, T13R/C16R/L70Q/A71D, T57I, M43I/C82R, V22L/M38V/M47T/A71D/L85M, I30V/T57I/L70P/A71D/A91T, V22I/L70M/A71D, N55D/K86M, L72P/T79I, L70P/F92S, T79P, E35D/M47I/L65P/D90N, L25S/E35D/M47I/D90N, S44P/167T/P74S/E81G/E95D, A71D, T13A/161N/A71D, E81K, A12V/M47V/L70M, K34E/T41A/L72V, T41S/A71D/V84A, E35D/A71D, E35D/M47I, K36R/G78A, Q33E/T41A, M47V/N48H, M47L/V68A, S44P/A71D, Q27H/M431/A71D/R73S, E35D/T57I/L70Q/A71D, M47I/E88D, M421/161V/A71D, P51A/A71D, H18Y/M47I/T57I/A71G, V20I/M47V/T57I/V84I, V20I/M47V/A71D, A71D/L72V/E95K, E35D/A71D, E35D/I67L/A71D, T13R/M42V/M47I/A71D, E35D, E35D/M47I/L70M, E35D/A71D/L72V, E35D/M43L/L70M, A26P/E35D/M431/L85Q/E88D, E35D/D46V/L85Q, M47V/169F/A71D/V831, H18Y/A26T/E35D/A71D/L85Q, E35D/M47L, E23D/M42V/M431/158V/L70R, V68M/L70M/A71D/E95K, N55I/T57I/169F, E35D/M431/A71D, T41S/T57I/L70R, V20I/A71D, E23G/A26S/E35D/T62N/A71D/L72V/L85M, V22L/E35D/M43L/A71G/D76H, A26E/E35D/M47L/L85Q, D46E/A71D, Y31H/E35D/T41S/V68L/K93R/R94W, A26E/Q33R/E35D/M47L/L85Q/K86E, A26E/Q33R/E35D/M47L/L85Q, E35D/M47L/L85Q, A26E/Q33L/E35D/M47L/L85Q, A26E/Q33L/E35D/M47L, H18Y/A26E/Q33L/E35D/M47L/L85Q, Q33L/E35D/M47I, H18Y/Q33L/E35D/M47I, Q33L/E35D/D46E/M47I, Q33R/E35D/D46E/M47I, H18Y/E35D/M47L, Q33L/E35D/M47V, Q33L/E35D/M47V/T79A, Q33L/E35D/T41S/M47V, Q33L/E35D/M47I/L85Q, Q33L/E35D/M47I/T62N/L85Q, Q33L/E35D/M47V/L85Q, A26E/E35D/M43T/M47L/L85Q/R94Q, Q33R/E35D/K37E/M47V/L85Q, V22A/E23D/Q33L/E35D/M47V, E24D/Q33L/E35D/M47V/K54R/L85Q, S15P/Q33L/E35D/M47L/L85Q, E7D/E35D/M47I/L97Q, Q33L/E35D/T41S/M43I, E35D/M47I/K54R/L85E, Q33K/E35D/D46V/L85Q, Y31S/E35D/M47L/T79L/E88G, H18L/V22A/E35D/M47L/N48T/L85Q, Q27H/E35D/M47L/L85Q/R94Q/E95K, Q33K/E35D/M47V/K89E/K93R, E35D/M47I/E77A/L85Q/R94W, A26E/E35D/M43I/M47L/L85Q/K86E/R94W, Q27H/Q33L/E35D/M47V/N55D/L85Q/K89N, H18Y/V20A/Q33L/E35D/M47V/Y53F, Q33L/E35D/M47L/A71G/F92S, V22A/R29H/E35D/D46E/M47I, Q33L/E35D/M43I/L85Q/R94W, H18Y/E35D/V68M/L97Q, Q33L/E35D/M47L/V68M/L85Q/E88D, Q33L/E35D/M43V/M47I/A71G, E35D/M47L/A71G/L97Q, E35D/M47V/A71G/L85M/L97Q, H18Y/Y31H/E35D/M47V/A71G/L85Q, E35D/D46E/M47V/L97Q, E35D/D46V/M47I/A71G/F92V, E35D/M47V/T62A/A71G/V83A/Y87H/L97M, Q33L/E35D/N48K/L85Q/L97Q, E35D/L85Q/K93T/E95V/L97Q, E35D/M47V/N48K/V68M/K89N, Q33L/E35D/M47I/N48D/A71G, Q27H/E35D/M47I/L85Q/D90G, E35D/M47I/L85Q/D90G, E35D/M47I/T62S/L85Q, A26E/E35D/M47L/A71G, E35D/M47I/Y87Q/K89E, V22A/E35D/M47I/Y87N, H18Y/A26E/E35D/M47L/L85Q/D90G, E35D/M47L/A71G/L85Q, E35D/M47V/A71G/E88D, E35D/A71G, E35D/M47V/A71G, I30V/E35D/M47V/A71G/A91V, V22D/E35D/M47L/L85Q, H18Y/E35D/N48K, E35D/T41S/M47V/A71G/K89N, E35D/M47V/N48T/L85Q, E35D/D46E/M47V/A71D/D90G, E35D/T41S/M43I/A71G/D90G, E35D/T41S/M43I/M47V/A71G, E35D/T41S/M43I/M47L/A71G, H18Y/V22A/E35D/

M47V/T62S/A71G, H18Y/A26E/E35D/M47L/V68M/A71G/D90G, E35D/K37E/M47V/N48D/L85Q/D90N, Q27H/E35D/D46V/M47L/A71G, V22L/Q27H/E35D/M47I/A71G, E35D/D46V/M47L/V68M/L85Q/E88D, E35D/T41S/M43V/M47I/L70M/A71G, E35D/D46E/M47V/N63D/L85Q, E35D/D46E/M47V/V68M/D90G/K93E, E35D/M43I/M47V/K89N, E35D/M47L/A71G/L85M/F92Y, V22D/E35D/M47L/L70M/L97Q, E35D/T41S/M47V/L97Q, E35D/Y53H/A71G/D90G/L97R, Q33L/E35D/M43I/Y53F/T62S/L85Q, E35D/M38T/D46E/M47V/N48S, Q33R/E35D/M47V/N48K/L85M/F92L, E35D/M38T/M43V/M47V/N48R/L85Q, T28Y/Q33H/E35D/D46V/M47I/A71G, E35D/N48K/L72V, E35D/T41S/N48T, D46V/M47I/A71G, M47I/A71G, E35D/M43I/M47L/L85M, E35D/M43I/D46E/A71G/L85M, H18Y/E35D/M47L/A71G/A91S, E35D/M47I/N48K/I61F, E35D/M47V/T62S/L85Q, M43I/M47L/A71G, E35D/M47V, E35D/M47L/A71G/L85M, V22A/E35D/M47L/A71G, E35D/M47L/A71G, E35D/D46E/M47I, Q27H/E35D/M47I, E35D/D46E/L85M, E35D/D46E/A91G, E35D/D46E, E35D/L97R, H18Y/E35D, Q27L/E35D/M47V/I61V/L85M, E35D/M47V/I61V/L85M, E35D/M47V/L85M/R94Q, E35D/M47V/N48K/L85M, H18Y/E35D/M47V/N48K, A26E/Q27R/E35D/M47L/N48Y/L85Q, E35D/D46E/M47L/V68M/L85Q/F92L, E35D/M47I/T62S/L85Q/E88D, E24D/Q27R/E35D/T41S/M47V/L85Q, S15T/H18Y/E35D/M47V/T62A/N64S/A71G/L85Q/D90N, E35D/M47L/V68M/A71G/L85Q/D90G, H18Y/E35D/M47I/V68M/A71G/R94L, Q33R/M47V/T62N/A71G, H18Y/V22A/E35D/T41S/M47V/T62N/A71G/A91G, E24D/E35D/M47L/V68M/E95V/L97Q, E35D/D46E/M47I/T62A/V68M/L85M/Y87C, E35D/D46E/M47I/V68M/L85M, E35D/D46E/M47L/V68M/A71G/Y87C/K93R, E35D/D46E/M47L/V68M/T79M/L85M, E35D/D46E/M47L/V68M/T79M/L85M/L97Q, E35D/D46E/M47V/V68M/L85Q, E35D/M43I/M47L/V68M, E35D/M47I/V68M/Y87N, E35D/M47L/V68M/E95V/L97Q, E35D/M47L/Y53F/V68M/A71G/K93R/E95V, E35D/M47V/N48K/V68M/A71G/L85M, E35D/M47V/N48K/V68M/L85M, E35D/M47V/V68M/L85M, E35D/M47V/V68M/L85M/Y87D, E35D/T41S/D46E/M47I/V68M/K93R/E95V, H18Y/E35D/D46E/M47I/V68M/R94L, H18Y/E35D/D46E/M47I/V68M/R94L, H18Y/E35D/M38I/M47L/V68M/L85M, H18Y/E35D/M47I/V68M/Y87N, H18Y/E35D/M47I/V68M/Y87N, H18Y/E35D/M47L/V68M/A71G/L85M, H18Y/E35D/M47L/V68M/A71G/L85M, H18Y/E35D/M47L/V68M/E95V/L97Q, H18Y/E35D/M47L/V68M/E95V/L97Q, H18Y/E35D/M47L/Y53F/V68M/A71G, H18Y/E35D/M47L/Y53F/V68M/A71G, H18Y/E35D/M47L/Y53F/V68M/A71G/K93R/E95V, H18Y/E35D/M47L/Y53F/V68M/A71G/K93R/E95V, H18Y/E35D/M47V/V68M/L85M, H18Y/E35D/M47V/V68M/L85M, H18Y/E35D/V68M/A71G/R94Q/E95V, H18Y/E35D/V68M/A71G/R94Q/E95V, H18Y/E35D/V68M/L85M/R94Q, H18Y/E35D/V68M/L85M/R94Q, H18Y/E35D/V68M/T79M/L85M, H18Y/V22D/E35D/M47V/N48K/V68M, Q27L/Q33L/E35D/T41S/M47V/N48K/V68M/L85M, Q33L/E35D/M47V/T62S/V68M/L85M, Q33R/E35D/M38I/M47L/V68M, R29C/E35D/M47L/V68M/A71G/L85M, S21P/E35D/K37E/D46E/M47I/V68M, S21P/E35D/K37E/D46E/M47I/V68M/R94L, T13R/E35D/M47L/V68M, T13R/Q27L/Q33L/E35D/T41S/M47V/N48K/V68M/L85M, T13R/Q33L/E35D/M47L/V68M/L85M, T13R/Q33L/E35D/M47V/T62S/V68M/L85M, T13R/Q33R/E35D/M38I/M47L/V68M, T13R/Q33R/E35D/M381/M47L/V68M/E95V/L97Q, T13R/Q33R/E35D/M381/M47L/V68M/L85M, T13R/Q33R/E35D/M381/M47L/V68M/L85M/R94Q, T13R/Q33R/E35D/M47L/V68M, T13R/Q33R/E35D/M47L/V68M/L85M, V22D/E24D/E35D/M47L/V68M, V22D/E24D/E35D/M47L/V68M/L85M/D90G, V22D/E24D/E35D/M47V/V68M, H18Y/E35D/M47V/V68M/A71G, H18C/A26P/E35D/M47L/V68M/A71G, H18I/A26P/E35D/M47V/V68M/A71G, H18L/A26N/D46E/V68M/A71G/D90G, H18L/E35D/M47V/V68M/A71G/D90G, H18T/A26N/E35D/M47L/V68M/A71G, H18V/A26K/E35D/M47L/V68M/A71G, H18V/A26N/E35D/M47V/V68M/A71G, H18V/A26P/E35D/M47V/V68L/A71G, H18V/A26P/E35D/M47L/V68M/A71G, H18V/E35D/M47V/V68M/A71G/D90G, H18Y/A26P/E35D/M47I/V68M/A71G, H18Y/A26P/E35D/M47V/V68M/A71G, H18Y/E35D/M47V/V68L/A71G/D90G, H18Y/E35D/M47V/V68M/A71G/D90G, A26P/E35D/M47I/V68M/A71G/D90G, H18V/A26G/E35D/M47V/V68M/A71G/D90G, H18V/A26S/E35D/M47L/V68M/A71G/D90G, H18V/A26R/E35D/M47L/V68M/A71G/D90G, H18V/A26D/E35D/M47V/V68M/A71G/D90G, H18V/A26Q/E35D/M47V/V68L/A71G/D90G, H18A/A26P/E35D/M47L/V68M/A71G/D90G, H18A/A26N/E35D/M47L/V68M/A71G/D90G, H18F/A26P/E35D/M47I/V68M/A71G/D90G, H18F/A26H/E35D/M47L/V68M/A71G/D90G, H18F/A26N/E35D/M47V/V68M/A71G/D90K, H18Y/A26N/E35D/M47F/V68M/A71G/D90G, H18Y/A26P/E35D/M47Y/V68I/A71G/D90G, H18Y/A26Q/E35D/M47T/V68M/A71G/D90G, H18R/A26P/E35D/D46N/M47V/V68M/A71G/D90P, and H18F/A26D/E35D/D46E/M47T/V68M/A7IG/D90G, where the position(s) of the amino acid substitution(s) correspond(s) to the positions of CD80 set forth in SEQ ID NO: 2.

48. The variant CD80 polypeptide of any of embodiments 44-47, wherein the increased affinity to the ectodomain of PD-L1 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100-fold, 150-fold, 200-fold, 250-fold, 300-fold, 350-fold, 400-fold, or 450-fold compared to binding affinity of the unmodified CD80 for the ectodomain of PD-L1.

49. The variant CD80 polypeptide of any of embodiments 1-38 and 44-48, wherein the variant CD80 exhibits decreased binding affinity to the ectodomain of CD28 compared to the binding affinity of the unmodified CD80 for the ectodomain of CD28.

50. The variant CD80 polypeptide of any of embodiments 1-38 and 44-49, wherein the decreased affinity to the ectodomain of CD28 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to binding affinity of the unmodified CD80 for the ectodomain of CD28.

51. The variant CD80 polypeptide of any of embodiments 1-50, wherein the variant polypeptide specifically binds to the ectodomain of PD-L1 with increased selectivity compared to the unmodified CD80 of the ectodomain of PD-L1.

52. The variant CD80 polypeptide of embodiment 51, wherein the increased selectivity comprises a greater ratio of binding of the variant polypeptide for PD-L1 versus CD28 compared to the ratio of binding of the unmodified CD80 polypeptide for PD-L1 versus CD28.

53. The variant CD80 polypeptide of embodiment 52, wherein the ratio is greater by at least or at least about 1.5-fold, 2.0-fold, 3.0-fold, 4.0-fold, 5-fold, 10-fold, 15-fold, 20-fold, 30-fold, 40-fold, 50-fold or more.

54. The variant CD80 polypeptide of any of embodiments 1-53 that is a soluble protein.

55. The variant CD80 polypeptide of any of embodiments 1-54, wherein: the variant CD80 polypeptide lacks the CD80 transmembrane domain and intracellular signaling domain; and/or the variant CD80 polypeptide is not capable of being expressed on the surface of a cell.

56. The variant CD80 polypeptide of any of embodiments 1-55, wherein the variant CD80 polypeptide is linked to a moiety that increases biological half-life of the polypeptide.

57. The variant CD80 polypeptide of any of embodiments 1-56, wherein the variant CD80 polypeptide is linked to a multimerization domain.

58. The variant CD80 polypeptide of embodiment 57, wherein the multimerization domain is an Fc domain or a variant Fc domain with reduced effector function.

59. The variant CD80 polypeptide of embodiment 58, wherein: the Fc domain is mammalian, optionally is human, mouse or rabbit; or the variant Fc domain comprises one or more amino acid modifications compared to an unmodified Fc domain that is mammalian, optionally human.

60. The variant CD80 polypeptide of embodiment 58 or embodiment 59, wherein: the Fe domain or variant thereof comprises the sequence of amino acids set forth in SEQ ID NO:277, SEQ ID NO:359, or SEQ ID NO: 1712 or a sequence of amino acids that exhibits at least 85%, 86%, 87%, 88%, 89%, 90%, 91%, 92%, 93%, 94%, 95%, 96%, 97%, 98% or 99% sequence identity to SEQ ID NO:277, SEQ ID NO:359, or SEQ ID NO: 1712; or the Fc domain comprises the sequence of amino acids set forth in SEQ ID NO:3039 or 3040 or a sequence of amino acids that exhibits at least 85%, 86%, 87%, 88%, 89%, 90%, 91%, 92%, 93%, 94%, 95%, 96%, 97%, 98% or 99% sequence identity to SEQ ID NO:3039 or 3040.

61. The variant CD80 polypeptide of any of embodiments 58-60, wherein the Fc domain comprises one or more amino acid modifications selected from among E233P, L234A, L234V, L235A, L235E, G236del, G237A, S267K, N297G, V302C, and K447del each by EU numbering, optionally wherein the one or more amino acid modifications are in a human IgG1.

62. The variant CD80 polypeptide of any of embodiments 58-60, wherein the Fc domain comprises the amino acid modification C220S by EU numbering.

63. The variant CD80 polypeptide of any of embodiments 58-62, wherein the Fc domain comprises the sequence of amino acids set forth in any of SEQ ID NOS:356-358, 376, and 1712-1715 or a sequence of amino acids that exhibits at least 85%, 86%, 87%, 88%, 89%, 90%, 91%, 92%, 93%, 94%, 95%, 96%, 97%, 98% or 99% sequence identity to any of SEQ ID NOS: 356-358, 376, and 1712-1715 and exhibits reduced effector function.

64. The variant CD80 polypeptide of any of embodiments 57-63, wherein the variant CD80 polypeptide is linked to the multimerization domain or Fc indirectly via a linker, optionally a G4S linker.

65. The variant CD80 polypeptide of any of embodiments 1-53, wherein the variant CD80 polypeptide is a transmembrane immunomodulatory protein further comprising a transmembrane domain, optionally wherein the transmembrane domain is linked, directly or indirectly, to the extracellular domain (ECD) or specific binding fragment thereof of the variant CD80 polypeptide.

66. The variant CD80 polypeptide of embodiment 65, wherein the transmembrane domain comprises the sequence of amino acids set forth as residues 243-263 of SEQ ID NO:1 or a functional variant thereof that exhibits at least 85% sequence identity to residues 243-263 of SEQ ID NO:1.

67. The variant CD80 polypeptide of embodiment 65 or embodiment 66, further comprising a cytoplasmic signaling domain, optionally wherein the cytoplasmic signaling domain is linked, directly or indirectly, to the transmembrane domain.

68. The variant CD80 polypeptide of embodiment 67, wherein the cytoplasmic signaling domain comprises the sequence of amino acids set forth as residues 264-288 of SEQ ID NO:1 or a functional variant thereof that exhibits at least 85% sequence identity to residues 254-288 of SEQ ID NO:1.

69. The variant CD80 polypeptide of any of embodiments 1-68, wherein the variant CD80 increases IFN-gamma (interferon-gamma) expression relative to the unmodified CD80 in an in vitro primary T-cell assay.

70. The variant CD80 polypeptide of any of embodiments 1-68, wherein the variant CD80 decreases IFN-gamma (interferon-gamma) expression relative to the unmodified CD80 in an in vitro primary T-cell assay.

71. The variant CD80 polypeptide of any of embodiments 1-70 that is deglycosylated.

72. An immunomodulatory protein, comprising the variant CD80 polypeptide of any of embodiments 1-71 and a half-life extending moiety.

73. The immunomodulatory protein of embodiment 72, wherein the half-life extending moiety comprises a multimerization domain, albumin, an albumin-binding polypeptide, Pro/Ala/Ser (PAS), a C-terminal peptide (CTP) of the beta subunit of human chorionic gonadotropin, polyethylene glycol (PEG), long unstructured hydrophilic sequences of amino acids (XTEN), hydroxyethyl starch (HES), an albumin-binding small molecule, or a combination thereof.

74. The immunomodulatory protein of embodiment 72 or embodiment 73, wherein the half-life extending moiety is or comprises Pro/Ala/Ser (PAS) and the variant CD80 polypeptide is PASylated.

75. The immunomodulatory protein of embodiment 72 or embodiment 73, wherein the half-life extending moiety is or comprises a multimerization domain.

76. The immunomodulatory protein of embodiment 75, wherein the multimerization domain is selected from an Fc region of an immunoglobulin, a leucine zipper, an isoleucine zipper or a zinc finger.

77. The immunomodulatory protein of embodiment 75 or embodiment 76, wherein the immunomodulatory protein is a multimer comprising a first variant CD80 polypeptide linked to a first multimerization domain and a second variant CD80 polypeptide linked to a second multimerization domain, wherein the first and second multimerization domains interact to form a multimer comprising the first and second variant CD80 polypeptide.

78. The immunomodulatory protein of embodiment 77, wherein the multimer is a dimer.

79. The immunomodulatory protein of embodiment 77 or embodiment 78, wherein the first variant CD80 polypeptide and the second variant CD80 polypeptide are the same.

80 The immunomodulatory protein of embodiment 78 or embodiment 79, wherein the dimer is a homodimer.

81. The immunomodulatory protein of embodiment 78, wherein the dimer is a heterodimer.

82. The immunomodulatory protein of any of embodiments 75-81, wherein the multimerization domain is or comprises an Fc region of an immunoglobulin.

83. The immunomodulatory protein of embodiment 82, wherein the Fc region is of an immunoglobulin G1 (IgG1) or an immunoglobulin $G_2$ (IgG2) protein.

84. The immunomodulatory protein of embodiment 82 or embodiment 83, wherein the immunoglobulin protein is human and/or the Fc region is human.

85. The immunomodulatory protein of any of embodiments 82-84, wherein the Fc region comprises the sequence of amino acids set forth in SEQ ID NO: 278 or a variant thereof that exhibits at least 90%, 91%, 92%, 93%, 94%, 95%, 96%, 97%, 98% or 99% sequence identity to SEQ ID NO:278.

86. The immunomodulatory protein of any of embodiments 82-85, wherein the Fc region comprises the sequence of amino acids set forth in SEQ ID NO: 277 or a variant thereof that exhibits at least 90%, 91%, 92%, 93%, 94%, 95%, 96%, 97%, 98% or 99% sequence identity to SEQ ID NO:277.

87. The immunomodulatory protein of any of embodiments 82-86, wherein the Fc region exhibits one or more effector functions.

88. The immunomodulatory protein of any of embodiments 82-87, wherein the immunomodulatory protein exhibits Fc-dependent CD28 costimulation, optionally in a T cell stimulation assay in the presence of antigen presenting cells, optionally wherein the T cells comprise Jurkat cells expressing an IL-2 reporter or primary human T cells producing inflammatory cytokines such as IL-2.

89. The immunomodulatory protein of any of embodiments 82-86, wherein the Fc region exhibits one or more effector function that is reduced compared to a wildtype Fc region, optionally wherein the wildtype Fc region is a human Fc of human IgG1.

90. The immunomodulatory protein of any of embodiments 87-89, wherein the one or more effector function is selected from among antibody dependent cellular cytotoxicity (ADCC), complement dependent cytotoxicity, programmed cell death and cellular phagocytosis.

91. The immunomodulatory protein of embodiment 89 or embodiment 90, wherein the Fc region is a variant Fc region comprising one or more amino acid substitutions compared to the wildtype Fc region.

92. The immunomodulatory protein of embodiment 91, wherein the one or more amino acid substitutions of the variant Fc region are selected from N297G, R292C/N297G/V302C, E233P/L234V/L235A/G236del/S267K or L234A/L235E/G237A, wherein the residue is numbered according to the EU index of Kabat.

93. The immunomodulatory protein of embodiment 92, wherein the variant Fc region further comprises the amino acid substitution C220S, wherein the residues are numbered according to the EU index of Kabat.

94. The immunomodulatory protein of any of embodiments 89-93, wherein the Fc region comprises the sequence of amino acid sequence set forth in any of SEQ ID NOS: 356-358 or a sequence of amino acids that exhibits at least 90%, 91%, 92%, 93%, 94%, 95%, 96%, 97%, 98%, 99% or more sequence identity to any of SEQ ID NOS: 356-358 and contains the amino acid substitutions.

95. The immunomodulatory protein of any of embodiments 89-94, wherein the Fc region comprises K447del, wherein the residue is numbered according to the EU index of Kabat.

96. The immunomodulatory protein of any of embodiments 89-93 and 95, wherein the Fc region comprises the sequence of amino acid sequence set forth in any of SEQ ID NOS: 1713-1715 or a sequence of amino acids that exhibits at least 90%, 91%, 92%, 93%, 94%, 95%, 96%, 97%, 98%, 99% or more sequence identity to any of SEQ ID NOS: 1713-1715 and contains the amino acid substitutions.

97. The immunomodulatory protein of any of embodiments 82-96, wherein the variant CD80 polypeptide is the variant CD80 polypeptide of any of embodiments 44-48.

98. The immunomodulatory protein of any of embodiments 72-97, wherein the immunomodulatory protein exhibits PD-L1-dependent CD28 costimulation, optionally in a T cell stimulation assay in the presence of antigen presenting cells expressing PD-L1, optionally wherein the T cells comprise Jurkat cells expressing an IL-2 reporter or primary human T cells producing inflammatory cytokines such as IL-2.

99. The immunomodulatory protein of any of embodiments 72-98, wherein the variant CD80 polypeptide is linked, directly or indirectly via a linker, to the half-life extending moiety, optionally the multimerization domain.

100. The immunomodulatory protein of embodiment 99, wherein the linker comprises 1 to 10 amino acids.

101. The immunomodulatory protein of embodiment 100, wherein the linker is selected from AAA, $G_4S$ (SEQ ID NO:1717) or $(G_4S)_2$ (SEQ ID NO:330).

102. An immunomodulatory protein, comprising the variant CD80 polypeptide of any of embodiments 1-71 linked, directly or indirectly via a linker, to a second polypeptide comprising an immunoglobulin superfamily (IgSF) domain of an IgSF family member.

103. The immunomodulatory protein of embodiment 102, wherein the IgSF domain is an affinity-modified IgSF domain, said affinity-modified IgSF domain comprising one or more amino acid modifications compared to the unmodified or wild-type IgSF domain of the IgSF family member.

104. The immunomodulatory protein of embodiment 103, wherein the IgSF domain is an affinity modified IgSF domain that exhibits altered binding to one or more of its cognate binding partner(s) compared to the binding of the unmodified or wild-type IgSF domain of the IgSF family member to the same one or more cognate binding partner(s).

105. The immunomodulatory protein of embodiment 104, wherein the IgSF domain exhibits increased binding to one or more of its cognate binding partner(s) compared to the binding of the unmodified or wild-type IgSF domain of the IgSF family member to the same one or more cognate binding partner(s).

106. The immunomodulatory protein of any of embodiments 102-105, wherein the variant CD80 polypeptide is a first CD80 variant polypeptide and the IgSF domain of the second polypeptide is an IgSF domain from a second variant CD80 polypeptide of any of embodiments 1-71, wherein the first and second CD80 variant polypeptides are the same or different.

107. The immunomodulatory protein of any one of embodiments 102-106, wherein the variant CD80 polypeptide is capable of specifically binding to CTLA-4 and the IgSF domain of the second polypeptide is capable of binding to a cognate binding partner other than one specifically bound by the CD80 variant polypeptide.

108. The immunomodulatory protein of any of embodiments 102-107, wherein the IgSF domain of the second polypeptide is a tumor-localizing moiety that binds to a ligand expressed on a tumor or that binds to a ligand expressed on a tumor or is an inflammatory-localizing moiety that binds to a cell or tissue associated with an inflammatory environment.

109. The immunomodulatory polypeptide of embodiment 108, wherein the ligand is B7H6.

110. The immunomodulatory polypeptide of embodiment 108 or embodiment 109, wherein the IgSF domain is from NKp30.

111. The immunomodulatory protein of any embodiments 102-107, wherein the IgSF domain of the second polypeptide is an IgSF domain of a ligand that binds to an inhibitory receptor, or is an affinity-modified IgSF domain thereof.

112. The immunomodulatory protein of embodiment 111, wherein the affinity-modified IgSF domain exhibits increased binding affinity and/or binding selectivity for the inhibitory receptor compared to binding of the unmodified IgSF domain to the same inhibitory receptor.

113. The immunomodulatory protein of embodiment 111 or 112, wherein: the inhibitory receptor is TIGIT or PD-1; or the ligand of the inhibitory receptor is CD155, CD112, PD-L1 or PD-L2.

114. The immunomodulatory protein of any of embodiments 102-107 and 111-113, wherein the second polypeptide is selected from:

(i) a wildtype CD112 comprising an IgSF domain set forth in any of SEQ ID NOS: 269, 734 or 829 or a variant CD112 polypeptide comprising an IgSF domain set forth in any of SEQ ID NOS: 735-828, 830-999, 1430-1501;

(ii) a wildtype CD155 comprising an IgSF set forth in any of SEQ ID NOS:268, 378 or 421 or a variant CD155 polypeptide comprising an IgSF domain set forth in any of SEQ ID NOS: 379-420, 422-733, 1502-1711;

(iii) a wildtype PD-L1 comprising an IgSF set forth in any of SEQ ID NOS: 251, 1000, 1721 or 1196 or a variant PD-L1 polypeptide comprising an IgSF set forth in any of SEQ ID NOS: 1001-1195, 1718-1720, 1722-1996;

(iv) a wildtype PD-L2 comprising an IgSF set forth in any of SEQ ID NOS: 252, 1197 or 1257 variant PD-L2 polypeptide comprising an IgSF domain set forth in any of SEQ ID NOS: 1198-1248, 1250-1256, 1258-1325, 1327-1401, 1403-1426;

(v) a sequence of amino acids that exhibits at least 90%, 91%, 92%, 93%, 94%, 95%, 95%, 97%, 98%, 99% or more sequence identity to any of the SEQ ID NOSs in (i)-(iv) and that comprises the amino acid substitution; or (vi) a specific binding fragment of any of (i)-(v).

115. The immunomodulatory protein of any of embodiments 102-114, further comprising a third polypeptide comprising an IgSF domain of an IgSF family member or an affinity-modified IgSF domain thereof, said affinity-modified IgSF domain comprising one or more amino acid modifications compared to the unmodified or wild-type IgSF domain of the IgSF family member.

116. The immunomodulatory protein of embodiment 115, wherein:

the third polypeptide is the same as the first and/or second polypeptide; or the third polypeptide is different from the first and/or second polypeptide.

117. The immunomodulatory protein of embodiment 115 and embodiment 116, wherein the third polypeptide is selected from:

(i) a wildtype CD112 comprising an IgSF domain set forth in any of SEQ ID NOS: 269, 734 or 829 or a variant CD112 polypeptide comprising an IgSF domain set forth in any of SEQ ID NOS: 735-828, 830-999, 1430-1501;

(ii) a wildtype CD155 comprising an IgSF set forth in any of SEQ ID NOS:268, 378 or 421 or a variant CD155 polypeptide comprising an IgSF domain set forth in any of SEQ ID NOS: 379-420, 422-733, 1502-1711;

(iii) a wildtype PD-L1 comprising an IgSF set forth in any of SEQ ID NOS: 251, 1000, 1721 or 1196 or a variant PD-L1 polypeptide comprising an IgSF set forth in any of SEQ ID NOS: 1001-1195, 1718-1720, 1722-1996;

(iv) a wildtype PD-L2 comprising an IgSF set forth in any of SEQ ID NOS: 252, 1197 or 1257 variant PD-L2 polypeptide comprising an IgSF domain set forth in any of SEQ ID NOS: 1198-1248, 1250-1256, 1258-1325, 1327-1401, 1403-1426;

(v) a sequence of amino acids that exhibits at least 90%, 91%, 92%, 93%, 94%, 95%, 95%, 97%, 98%, 99% or more sequence identity to any of the SEQ ID NOSs in (i)-(iv) and that comprises the amino acid substitution; or (vi) a specific binding fragment of any of (i)-(v).

118. The immunomodulatory protein of any of embodiments 102-117, wherein the IgSF domain or affinity-modified IgSF domain thereof, optionally of the second or third polypeptide is or comprises an IgV domain.

119. The immunomodulatory protein of any of embodiments 102-118, wherein the variant CD80 polypeptide is or comprises an IgV domain.

120. The immunomodulatory protein of any of embodiments 115-119, further comprising at least one additional polypeptide comprising an IgSF domain of an IgSF family member or an affinity-modified IgSF domain thereof, said affinity-modified IgSF domain comprising one or more amino acid modifications compared to the unmodified or wild-type IgSF domain of the IgSF family member.

121. The immunomodulatory protein of any of embodiments 102-120, wherein the immunomodulatory protein further comprises a multimerization domain linked to at least one of the variant CD80 polypeptide, or the second polypeptide.

122. The immunomodulatory protein of any of embodiments 115-120, wherein the immunomodulatory protein further comprises a multimerization domain linked to at least one of the variant CD80 polypeptide, the second polypeptide and/or the third polypeptide.

123. The immunomodulatory protein of embodiment 121 or 122, wherein the multimerization domain is an Fc domain or a variant thereof with reduced effector function.

124. The immunomodulatory protein of any of embodiments 121-123, wherein the multimerization domain promotes heterodimer formation.

125. An immunomodulatory protein comprising a first variant CD80 polypeptide of any of embodiments 57-64 in which the multimerization domain is a first multimerization domain and a second variant CD80 polypeptide of any of embodiments 57-64 in which the multimerization domain is a second multimerization domain, wherein the first and second multimerization domains interact to form a multimer containing the first and second variant CD80 polypeptide.

126. An immunomodulatory protein comprising the immunomodulatory protein of any of embodiments 77-81, wherein the multimerization domain is a first multimerization domain and interacts with a second multimerization domain to form a multimer comprising the immunomodulatory protein.

127. The immunomodulatory protein of embodiment 126, wherein the immunomodulatory protein is a first immunomodulatory protein and a second immunomodulatory protein is linked directly or indirectly via a linker to the second multimerization domain, wherein the multimer comprises the first and second immunomodulatory protein.

128. The immunomodulatory protein of embodiment 127, wherein the second immunomodulatory protein is an immunomodulatory protein of any of embodiments 77-81, wherein the multimerization domain is the second multimerization domain.

129. The immunomodulatory protein of any of embodiments 125-128, wherein the multimer is a dimer.

130. The immunomodulatory protein of any of embodiments 125-129 that is a homodimer.

131. The immunomodulatory protein of any of embodiments 125-129 that is a heterodimer.

132. The immunomodulatory protein of any of embodiments 125-131, wherein the first and/or second multimerization domain is an Fc domain or a variant thereof with reduced effector function.

133. The immunomodulatory protein of any of embodiments 125-132, wherein the first and second multimerization domain is the same or different.

134. A conjugate, comprising a variant CD80 polypeptide of any of embodiments 1-71 or an immunomodulatory protein of any of embodiments 72-133 linked to a moiety, optionally wherein the conjugate is a fusion protein.

135. The conjugate of embodiment 134, wherein the moiety is a targeting moiety that specifically binds to a molecule on the surface of a cell.

136. The conjugate of embodiment 135, wherein the targeting moiety specifically binds to a molecule on the surface of an immune cell, optionally wherein the immune cell is an antigen presenting cell or a lymphocyte.

137. The conjugate of embodiment 135, wherein the targeting moiety is a tumor-localizing moiety that binds to a molecule on the surface of a tumor.

138. The conjugate of any of embodiments 134-137, wherein the moiety is a protein, a peptide, nucleic acid, small molecule or nanoparticle.

139. The conjugate of any of embodiments 134-138, wherein the moiety is an antibody or antigen-binding fragment.

140. The conjugate of any of embodiments 134-139, wherein the conjugate is divalent, tetravalent, hexavalent or octavalent.

141. The conjugate of any of embodiments 134-139 that is a fusion protein.

142. A nucleic acid molecule(s), encoding a variant CD80 polypeptide of any of embodiments 1-71, an immunomodulatory protein of any of embodiments 72-133 or a conjugate that is a fusion protein of any of embodiments 134-141.

143. The nucleic acid molecule of embodiment 142 that is a synthetic nucleic acid.

144. The nucleic acid molecule of embodiment 142 or embodiment 143 that is cDNA.

145. A vector, comprising the nucleic acid molecule of any of embodiments 142-144.

146. The vector of embodiment 145 that is an expression vector.

147. The vector of embodiment 145 or embodiment 146, wherein the vector is a mammalian expression vector or a viral vector.

148. A cell, comprising the vector of embodiment 146 or embodiment 147.

149. The cell of embodiment 148 that is a mammalian cell.

150. The cell of embodiment 148 or embodiment 149 that is a human cell.

151. A method of producing a variant CD80 polypeptide or an immunomodulatory protein, comprising introducing the nucleic acid molecule of any of embodiments 142-144 or vector of any of embodiments 145-147 into a host cell under conditions to express the protein in the cell.

152. The method of embodiment 151, further comprising isolating or purifying the variant CD80 polypeptide or immunomodulatory protein from the cell.

153. A method of engineering a cell expressing a variant CD80 variant polypeptide, comprising introducing a nucleic acid molecule encoding the variant CD80 polypeptide of any of embodiments 1-71 into a host cell under conditions in which the polypeptide is expressed in the cell.

154. An engineered cell, expressing a variant CD80 polypeptide of any of embodiments 1-71, an immunomodulatory protein of any of embodiments 72-133, a conjugate that is a fusion protein of any of embodiments 134-141, a nucleic acid molecule of any of embodiments 142-145 or a vector of any of embodiments 145-147.

155. The engineered cell of embodiment 154, wherein the variant CD80 polypeptide or immunomodulatory protein is encoded by a nucleic acid comprising a sequence of nucleotides encoding a signal peptide.

156. The engineered cell of embodiment 154 or embodiment 155, wherein the variant CD80 polypeptide or immunomodulatory protein does not comprise a transmembrane domain and/or is not expressed on the surface of the cell.

157. The engineered cell of any of embodiments 154-156, wherein the variant CD80 polypeptide or immunomodulatory protein is secreted or is capable of being secreted from the engineered cell.

158. The engineered cell of embodiment 154 or embodiment 155, wherein the engineered cell comprises a variant CD80 polypeptide that comprises a transmembrane domain and/or is the transmembrane immunomodulatory protein of any of embodiments 65-71.

159. The engineered cell of embodiment 154, embodiment 155 or embodiment 158, wherein the variant CD80 polypeptide is expressed on the surface of the cell.

160. The engineered cell of any of embodiments 154-159, wherein the cell is an immune cell.

161. The engineered cell of embodiment 160, wherein the immune cell is an antigen presenting cell (APC) or a lymphocyte.

162. The engineered cell of any of embodiments 159-161 that is a primary cell.

163. The engineered cell of any of embodiments 159-162, wherein the cell is a mammalian cell.

164. The engineered cell of any of embodiments 159-163, wherein the cell is a human cell.

165. The engineered cell of any of embodiments 159-164, wherein the cell is a lymphocyte and the lymphocyte is a T cell.

166. The engineered cell of embodiment 161, wherein the cell is an APC and the APC is an artificial APC.

167. The engineered cell of any of embodiments 154-166, further comprising a chimeric antigen receptor (CAR) or an engineered T-cell receptor.

168. An infectious agent, comprising a nucleic acid molecule encoding a variant CD80 polypeptide of any of embodiments 1-71, an immunomodulatory protein of any of embodiments 72-133 or a conjugate that is a fusion protein of any of embodiments 134-141.

169. The infectious agent of embodiment 168, wherein the encoded variant CD80 polypeptide, immunomodulatory protein or conjugate does not comprise a transmembrane domain and/or is not expressed on the surface of a cell in which it is expressed.

170. The infectious agent of embodiment 168 or embodiment 169, wherein the encoded variant CD80 polypeptide, immunomodulatory polypeptide or conjugate is secreted or is capable of being secreted from a cell in which it is expressed.

171. The infectious agent of embodiment 168, wherein the encoded variant CD80 polypeptide comprises a transmembrane domain.

172. The infectious agent of embodiment 168 or embodiment 171, wherein the encoded variant CD80 polypeptide is expressed on the surface of a cell in which it is expressed.

173. The infectious agent of any of embodiments 168-172, wherein the infectious agent is a bacterium or a virus.

174. The infectious agent of embodiment 173, wherein the infectious agent is a virus and the virus is an oncolytic virus.

175. The infectious agent of embodiment 174, wherein the oncolytic virus is an adenovirus, adeno-associated virus, herpes virus, Herpes Simplex Virus, Reovirus, Newcastle Disease virus, parvovirus, measles virus, vesicular stomatitis virus (VSV), Coxsackie virus or a Vaccinia virus.

176. The infectious agent of embodiment 175, wherein the virus specifically targets dendritic cells (DCs) and/or is dendritic cell-tropic.

177. The infectious agent of embodiment 176, wherein the virus is a lentiviral vector that is pseudotyped with a modified Sindbis virus envelope product.

178. The infectious agent of any of embodiments 168-177, further comprising a nucleic acid molecule encoding a further gene product that results in death of a target cell or that can augment or boost an immune response.

179. The infectious agent of embodiment 178, wherein the further gene product is selected from an anticancer agent, an anti-metastatic agent, an antiangiogenic agent, an immunomodulatory molecule, an immune checkpoint inhibitor, an antibody, a cytokine, a growth factor, an antigen, a cytotoxic gene product, a pro-apoptotic gene product, an anti-apoptotic gene product, a cell matrix degradative gene, genes for tissue regeneration or reprogramming human somatic cells to pluripotency.

180. A pharmaceutical composition, comprising the variant CD80 polypeptide of any of embodiments 1-71, an immunomodulatory protein of any of embodiments 72-133, a conjugate of any of embodiments 134-141, an engineered cell of any of embodiments 154-167 or an infectious agent of any of embodiments 168-179.

181. The pharmaceutical composition of embodiment 180, comprising a pharmaceutically acceptable excipient.

182. The pharmaceutical composition of embodiment 179 or 180, wherein the pharmaceutical composition is sterile.

183. An article of manufacture comprising the pharmaceutical composition of any of embodiments 179-182 in a vial.

184. The article of manufacture of embodiment 183, wherein the vial is sealed.

185. A kit comprising the pharmaceutical composition of any of embodiments 179-182, and instructions for use.

186. A kit comprising the article of manufacture according to embodiment 183 and 184, and instructions for use.

187. A method of modulating an immune response in a subject, comprising administering the pharmaceutical composition of any of embodiments 180-182 to the subject.

188. A method of modulating an immune response in a subject, comprising administering the immunomodulatory protein of any of embodiments 72-101.

189. The method of embodiment 187 or 188, wherein the immune response is increased.

190. The method of embodiment 188 or embodiment 189, wherein the immunomodulatory protein is the immunomodulatory protein of embodiment 88 that exhibits Fc-dependent CD28 costimulation.

191. The method of any of embodiments 186-188, wherein the immunomodulatory protein is the immunomodulatory protein of embodiment 98 that exhibits PD-L1-dependent CD28 costimulation, optionally wherein the immunomodulatory protein comprises the variant CD80 polypeptide of any of claims.

192. A method of modulating an immune response in a subject, comprising administering the engineered cells of any of embodiments 154-167.

193. The method of embodiment 192, wherein the engineered cells are autologous to the subject.

194. The method of embodiment 192, wherein the engineered cells are allogenic to the subject.

195. The method of any of embodiments 187-194, wherein modulating the immune response treats a disease or condition in the subject.

196. The method of any of embodiments 187-195, wherein the immune response is increased.

197. The method of any of embodiments 187-191, 195, or 196, wherein a variant CD80 polypeptide or immunomodulatory protein that is soluble, optionally that lacks a CD80 transmembrane and intracellular signaling domain, is administered to the subject.

198. The method of embodiment 197, wherein the variant CD80 polypeptide or immunomodulatory protein is an Fc fusion protein.

199. The method of any of embodiments 187-198, wherein a variant CD80 polypeptide of any of embodiments 1-68 and 71, or the immunomodulatory protein of any of embodiments 72-133 is administered to the subject.

200. The method of any of embodiments 192-196, wherein an engineered cell comprising a secretable variant CD80 polypeptide is administered to the subject.

201. The method of any of embodiments 192-196 and 200, wherein an engineered cell of any of embodiments 154-167 is administered to the subject.

202. The method of any of embodiments 187-191, 195 and 196, wherein an infectious agent encoding a variant CD80 polypeptide that is a secretable immunomodulatory protein is administered to the subject, optionally under conditions in which the infectious agent infects a tumor cell or immune cell and the secretable immunomodulatory protein is secreted from the infected cell.

203. The method of any of embodiments 187-202, wherein the disease or condition is a tumor or cancer.

204. The method of any one of embodiments 187-203, wherein the disease or condition is selected from melanoma, lung cancer, bladder cancer, a hematological malignancy, liver cancer, brain cancer, renal cancer, breast cancer, pancreatic cancer, colorectal cancer, spleen cancer, prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer.

205. The method of any of embodiments 187, 188 and 192-195, wherein the immune response is decreased.

206. The method of any of embodiments 187, 188, 192-195 and 205, wherein an immunomodulatory protein or conjugate comprising a variant CD80 polypeptide linked to a moiety that localizes to a cell or tissue of an inflammatory environment is administered to the subject.

207. The method of embodiment 206, wherein the moiety comprises an antibody or an antigen-binding fragment thereof or comprises a second polypeptide comprising a wild-type IgSF domain or variant thereof.

208. The method of any of embodiments 187-191, 195 and 205-207, wherein the immunomodulatory protein of any of embodiments 72-133 or the conjugate of any of embodiments 134-141 is administered to the subject, optionally wherein the immunomodulatory protein or the conjugate comprises a variant CD80 polypeptide that exhibits increased binding affinity o CTLA-4.

209. The method of any of embodiments 187-195 and 205, wherein a variant CD80 polypeptide comprising a transmembrane domain is administered to the subject.

210. The method of any of embodiments 192-195, 205, and 209, wherein an engineered cell comprising a variant CD80 polypeptide that is a transmembrane immunomodulatory protein of any of embodiments 158-167 is administered to the subject.

211. The method of any of embodiments 187, 195 and 205, wherein an infectious agent encoding a variant CD80 polypeptide that is a transmembrane immunomodulatory protein is administered to the subject, optionally under conditions in which the infectious agent infects a tumor cell or immune cell and the transmembrane immunomodulatory protein is expressed on the surface of the infected cell.

212. The method of any of embodiments 195 and 205-211, wherein the disease or condition is an inflammatory or autoimmune disease or condition.

213. The method of any of embodiments 195 and 205-212 wherein the disease or condition is an Antineutrophil cytoplasmic antibodies (ANCA)-associated vasculitis, a vasculitis, an autoimmune skin disease, transplantation, a Rheumatic disease, an inflammatory gastrointestinal disease, an inflammatory eye disease, an inflammatory neurological disease, an inflammatory pulmonary disease, an inflammatory endocrine disease, or an autoimmune hematological disease.

214. The method of any of embodiments 195 and 205-213, wherein the disease or condition is selected from inflammatory bowel disease, transplant, Crohn's disease, ulcerative colitis, multiple sclerosis, asthma, rheumatoid arthritis, or psoriasis.

215. A method of increasing an immune response in a subject, the method comprising administering an immunomodulatory protein comprising a variant CD80 polypeptide, wherein the variant CD80 polypeptide comprises one or more amino acid modifications at one or more positions in the IgV domain or IgC domain or a specific binding fragment thereof of in an unmodified CD80 or specific binding fragment thereof, wherein the immunomodulatory protein exhibits PD-L1-dependent CD28 costimulation.

216. The method of embodiment 215, wherein the variant CD80 polypeptide exhibits increased binding affinity to the ectodomain of PD-L1 compared to the binding affinity of the unmodified CD80 for the ectodomain of PD-L1.

217. A method of mediating CD28 agonism by PD-L1-dependent CD28 costimulation in a subject, the method comprising administering an immunomodulatory protein comprising a variant CD80 polypeptide, said variant CD80 polypeptide comprising one or more amino acid modifications at one or more positions in the IgV domain or IgC domain or the specific binding fragment thereof of an unmodified CD80 or specific binding fragment thereof, wherein the variant CD80 polypeptide exhibits increased binding affinity to the ectodomain of PD-L1 compared to the binding affinity of the unmodified CD80 for the ectodomain of PD-L1.

218. The method of embodiment 216 or embodiment 217, wherein the increased affinity to the ectodomain of PD-L1 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100-fold, 150-fold, 200-fold, 250-fold, 300-fold, 350-fold, 400-fold, or 450-fold compared to binding affinity of the unmodified CD80 for the ectodomain of PD-L1.

219. The method of any of embodiments 215-219, which is for use in treating a disease or condition.

220. The method of any of embodiments 217-219, wherein PD-L1-dependent CD28 costimulation is assessed in a T cell stimulation assay in the presence of antigen presenting cells expressing PD-L1, optionally wherein the T cell stimulation assay is an in vitro assay, optionally wherein the T cells comprise Jurkat cells expressing an IL-2 reporter.

221. The method of any of embodiments 187-220, wherein: prior to the administering, selecting a subject for treatment that has a tumor comprising cells positive for surface PD-L1, optionally wherein the cells are tumor cells or tumor infiltrating immune cells; or the subject has been selected as having a tumor comprising cells surface positive for PD-L1, optionally wherein the cells are tumor cells or tumor infiltrating immune cells.

222. The method of embodiment 221, wherein selecting a subject comprises:

(a) contacting a tumor tissue sample from a subject with a binding reagent capable of specifically binding the ectodomain of PD-L1;

(b) detecting the presence of the bound binding reagent in or on cells of the tumor tissue sample, optionally wherein the cells are tumor cells or tumor infiltrating immune cells; and (c) if the tumor tissue sample comprises a detectable level of cells surface positive for PD-L1, selecting the subject for treatment.

223. The method of any of claims 187-222, wherein:

prior to the administering, selecting a subject for treatment that has a tumor comprising cells surface positive for CD28, optionally wherein the cells are tumor infiltrating lymphocytes, optionally wherein the lymphocytes are T cells, optionally CD8+ T cells; or the subject has been selected as having a tumor comprising cells surface positive for CD28, optionally wherein the cells are tumor infiltrating lymphocytes, optionally wherein the lymphocytes are T cells, optionally CD8+ T cells.

224. The method of embodiment 223, wherein selecting the subject comprises:

(a) contacting a tumor tissue sample from a subject with a binding reagent capable of specifically binding the ectodomain of CD28;

(b) detecting the presence of the bound binding reagent in or on cells of the tumor tissue sample, optionally wherein the cells are tumor infiltrating lymphocytes, optionally wherein the lymphocytes are T cells, optionally CD8+ T cells; and (c) if the tumor tissue sample comprises a detectable level of cells surface positive for CD28, selecting the subject for treatment.

225. A method of selecting a subject for treatment, the method comprising:

(a) contacting a tumor tissue sample from a subject with a binding reagent capable of specifically binding PD-L1; and (b) detecting the presence of the bound binding reagent in or on cells of the tumor tissue sample, optionally wherein the cells are tumor cells or tumor infiltrating immune cells; and (c) if the tumor sample comprises a detectable level of cells surface positive for PD-L1, selecting the subject for treatment with an immunomodulatory protein comprising a variant CD80 polypeptide, said variant CD80 polypeptide comprising one or more amino acid modifications at one or more positions in the IgV domain or IgC domain or the specific binding fragment thereof of an unmodified CD80 or specific binding fragment thereof, wherein the variant CD80 polypeptide exhibits increased binding affinity to the ectodomain of PD-L1 compared to the binding affinity of the unmodified CD80 for the ectodomain of PD-L1.

226. The method of embodiment 225, comprising contacting the tumor tissue sample with a binding reagent capable of specifically binding CD28, wherein the subject is selected if the tumor tissue sample further comprises a detectable level of tumor infiltrating lymphocytes positive for CD28, optionally wherein the lymphocytes are T cells, optionally CD8+ T cells.

227. The method of any of embodiments 222 and 224-226, wherein the tumor tissue sample comprises tumor infiltrating immune cells, tumor cells, stromal cells, or any combination thereof.

228. The method of any of embodiments 222 and 224-227, wherein the binding reagent is an antibody or antigen-binding fragment, protein ligand or binding partner, an aptamer, an affimer, a peptide or a hapten.

229. The method of embodiment 222, 224, 227 or 228, wherein the binding reagent is an anti-PD-L1 antibody or antigen-binding fragment.

230. The method of any of embodiments 222-229, wherein the binding reagent comprises a variant CD80 polypeptide of any of embodiments 1-71.

231. The method of embodiment 230, wherein the variant CD80 polypeptide comprises the IgV domain or a specific binding fragment thereof.

232. The method of embodiment 230 or embodiment 231, wherein the IgV domain or specific binding fragment thereof is the only CD80 portion of the binding reagent.

233. The method of any of embodiments 230-232, wherein the variant CD80 polypeptide exhibits increased affinity for binding to PD-L1 compared to the wildtype or unmodified CD80 polypeptide.

234. The method of any of embodiments 222 and 224-233, wherein the binding reagent is linked, directly or indirectly, to a moiety that is a detectable moiety or a moiety capable of detection.

235. The method of embodiment 234, wherein the moiety is an Fc region.

236. The method of embodiment 235, wherein the Fc region is non-human, optionally is mouse or rabbit.

237. The method of any of embodiments 222 and 224-236, wherein detecting the presence of bound binding reagent is by immunohistochemistry, pseudo-immunohistochemistry, immunofluorescence, flow cytometry, ELISA or immunoblotting.

238. The method of any of embodiments 225-237, further comprising administering the immunomodulatory protein to the subject.

239. The method of any of embodiments 187-238, wherein the subject is a human subject.

240. The method of any of any of embodiments 215-239, wherein the immunomodulatory protein is a multimer comprising a first variant CD80 polypeptide linked to a first multimerization domain and a second variant CD80 polypeptide linked to a second multimerization domain, wherein the first and second multimerization domain interact to form a multimer comprising the first and second variant CD80 polypeptide.

241. The method of embodiment 240, wherein the multimer is a dimer.

242. The method of embodiment 240 or embodiment 241, wherein the first variant CD80 polypeptide and the second variant CD80 polypeptide are the same.

243. The method of any of embodiments 240-242, wherein the multimerization domain is or comprises an Fc region.

244. The method of embodiment 243, wherein the Fc region is a variant Fc region comprising one or more amino acid substitutions compared to a wildtype Fc region, wherein the Fc region exhibits one or more effector function that is reduced compared to the wildtype Fc region, optionally where the wildtype Fc is human IgG1.

245. The method of any of embodiments 215-244, wherein the CD80 polypeptide comprises one or more amino acid modifications in an unmodified CD80 or specific binding fragment thereof, corresponding to position(s) 7, 12, 13, 15, 16, 18, 20, 21, 22, 23, 24, 25, 26, 27, 28, 29, 30, 31, 33, 34, 35, 36, 37, 38, 41, 42, 43, 44, 46, 47, 48, 51, 53, 54, 55, 57, 58, 61, 62, 63, 64,65,67,68,69,70,71,72,73,74,76,77, 78,79, 81,82, 83,84, 85,86, 87,88,89,90,91,92, 93, 94, 95, and/or 97, with reference to numbering of SEQ ID NO: 2.

246. The method of any of embodiments 215-245, wherein the CD80 polypeptide comprises one or more amino acid modifications in an unmodified CD80 or specific binding fragment thereof, selected from among E7D, A12V, T13A, T13R, S15P, S15T, C16R, H18A, H18C, H18F, H18I, H18L, H18T, H18V, H18Y, V20A, V20I, S21P, V22A, V22D, V22I, V22L, E23D, E23G, E24D, L25S, A26D, A26E, A26G, A26H, A26K, A26N, A26P, A26Q, A26R, A26S, A26T, Q27H, Q27L, Q27R, T28Y, R29C, R29H, 130T, 130V, Y31H, Y31S, Q33E, Q33H, Q33K, Q33L, Q33R, K34E, E35D, K36R, K37E, M381, M38T, M38V, T41A, T41S, M421, M42V, M43I, M43L, M43T, M43V, S44P, D46E, D46N, D46V, M47F, M47I, M47L, M47T, M47V, M47Y, N48D, N48H, N48K, N48R, N48S, N48T, N48Y, P51A, Y53F, Y53H, K54R, N55D, N55I, T57I, 158V, I61F, I61N, I61V, T62A, T62N, T62S, N63D, N64S, L65P, I67L, I67T, V68A, V68I, V68L, V68M, I69F, L70M, L70P, L70Q, L70R, A71D, A71G, L72P, L72V, R73S, P74S, D76H, E77A, G78A, T79A, T79I, T79L, T79M, T79P, E81G, E81K, C82R, V83A, V83I, V84A, V84I, L85E, L85M, L85Q, K86E, K86M, Y87C, Y87D, Y87H, Y87N, Y87Q, E88D, E88G, K89E, K89N, D90G, D90K, D90N, D90P, A91G, A91S, A91T, A91V, F92L, F92S, F92V, F92Y, K93E, K93R, K93T, R94L, R94Q, R94W, E95D, E95K, E95V, L97M, L97Q, and L97R, where the position(s) of the amino acid substitution(s) correspond(s) to the positions of CD80 set forth in SEQ ID NO: 2.

247. The method of any of embodiments 215-245, wherein the one or more amino acid modification(s) is/are selected from among: Q27H/T41S/A71D, I30T/L70R, T13R/C16R/L70Q/A71D, T57I, M431/C82R, V22L/M38V/M47T/A71D/L85M, I30V/T57I/L70P/A71D/A91T, V22I/L70M/A71D, N55D/K86M, L72P/T79I, L70P/F92S, T79P, E35D/M47I/L65P/D90N, L25S/E35D/M47I/D90N, S44P/I67T/P74S/E81G/E95D, A71D, T13A/I61N/A71D, E81K, A12V/M47V/L70M, K34E/T41A/L72V, T41S/A71D/V84A, E35D/A71D, E35D/M47I, K36R/G78A, Q33E/T41A, M47V/N48H, M47L/V68A, S44P/A71D, Q27H/M43I/A71D/R73S, E35D/T57I/L70Q/A71D, M47I/E88D, M42I/I61V/A71D, P51A/A71D, H18Y/M47I/T57I/A71G, V20I/M47V/T57I/V84I, V20I/M47V/A71D, A71D/L72V/E95K, E35D/A71D, E35D/167L/A71D, T13R/M42V/M47I/A71D, E35D, E35D/M47I/L70M, E35D/A71D/L72V, E35D/M43L/L70M, A26P/E35D/M43I/L85Q/E88D, E35D/D46V/L85Q, M47V/I69F/A71D/V83I, H18Y/A26T/E35D/A71D/L85Q, E35D/M47L, E23D/M42V/M43I/I58V/L70R, V68M/L70M/A71D/E95K, N55I/T57I/I69F, E35D/M43I/A71D, T41S/T57I/L70R, V20I/A71D, E23G/A26S/E35D/T62N/A71D/L72V/L85M, V22L/E35D/M43L/A71G/D76H, A26E/E35D/M47L/L85Q, D46E/A71D, Y31H/E35D/T41S/V68L/K93R/R94W, A26E/Q33R/E35D/M47L/L85Q/K86E, A26E/Q33R/E35D/M47L/L85Q, E35D/M47L/L85Q, A26E/Q33L/E35D/M47L/L85Q, A26E/Q33L/E35D/M47L, H18Y/A26E/

Q33L/E35D/M47L/L85Q, Q33L/E35D/M47I, H18Y/Q33L/E35D/M47I, Q33L/E35D/D46E/M47I, Q33R/E35D/D46E/M47I, H18Y/E35D/M47L, Q33L/E35D/M47V, Q33L/E35D/M47V/T79A, Q33L/E35D/T41S/M47V, Q33L/E35D/M47I/L85Q, Q33L/E35D/M47I/T62N/L85Q, Q33L/E35D/M47V/L85Q, A26E/E35D/M43T/M47L/L85Q/R94Q, Q33R/E35D/K37E/M47V/L85Q, V22A/E23D/Q33L/E35D/M47V, E24D/Q33L/E35D/M47V/K54R/L85Q, S15P/Q33L/E35D/M47L/L85Q, E7D/E35D/M47I/L97Q, Q33L/E35D/T41S/M43I, E35D/M47I/K54R/L85E, Q33K/E35D/D46V/L85Q, Y31S/E35D/M47L/T79L/E88G, H18L/V22A/E35D/M47L/N48T/L85Q, Q27H/E35D/M47L/L85Q/R94Q/E95K, Q33K/E35D/M47V/K89E/K93R, E35D/M47I/E77A/L85Q/R94W, A26E/E35D/M43I/M47L/L85Q/K86E/R94W, Q27H/Q33L/E35D/M47V/N55D/L85Q/K89N, H18Y/V20A/Q33L/E35D/M47V/Y53F, Q33L/E35D/M47L/A71G/F92S, V22A/R29H/E35D/D46E/M47I, Q33L/E35D/M43I/L85Q/R94W, H18Y/E35D/V68M/L97Q, Q33L/E35D/M47L/V68M/L85Q/E88D, Q33L/E35D/M43V/M47I/A71G, E35D/M47L/A71G/L97Q, E35D/M47V/A71G/L85M/L97Q, H18Y/Y31H/E35D/M47V/A71G/L85Q, E35D/D46E/M47V/L97Q, E35D/D46V/M47I/A71G/F92V, E35D/M47V/T62A/A71G/V83A/Y87H/L97M, Q33L/E35D/N48K/L85Q/L97Q, E35D/L85Q/K93T/E95V/L97Q, E35D/M47V/N48K/V68M/K89N, Q33L/E35D/M47I/N48D/A71G, Q27H/E35D/M47I/L85Q/D90G, E35D/M47I/L85Q/D90G, E35D/M47I/T62S/L85Q, A26E/E35D/M47L/A71G, E35D/M47I/Y87Q/K89E, V22A/E35D/M47I/Y87N, H18Y/A26E/E35D/M47L/L85Q/D90G, E35D/M47L/A71G/L85Q, E35D/M47V/A71G/E88D, E35D/A71G, E35D/M47V/A71G, I30V/E35D/M47V/A71G/A91V, V22D/E35D/M47L/L85Q, H18Y/E35D/N48K, E35D/T41S/M47V/A71G/K89N, E35D/M47V/N48T/L85Q, E35D/D46E/M47V/A71D/D90G, E35D/T41S/M43I/A71G/D90G, E35D/T41S/M43I/M47V/A71G, E35D/T41S/M43I/M47L/A71G, H18Y/V22A/E35D/M47V/T62S/A71G, H18Y/A26E/E35D/M47L/V68M/A71G/D90G, E35D/K37E/M47V/N48D/L85Q/D90N, Q27H/E35D/D46V/M47L/A71G, V22L/Q27H/E35D/M47I/A71G, E35D/D46V/M47L/V68M/L85Q/E88D, E35D/T41S/M43V/M47I/L70M/A71G, E35D/D46E/M47V/N63D/L85Q, E35D/D46E/M47V/V68M/D90G/K93E, E35D/M43I/M47V/K89N, E35D/M47L/A71G/L85M/F92Y, V22D/E35D/M47L/L70M/L97Q, E35D/T41S/M47V/L97Q, E35D/Y53H/A71G/D90G/L97R, Q33L/E35D/M43I/Y53F/T62S/L85Q, E35D/M38T/D46E/M47V/N48S, Q33R/E35D/M47V/N48K/L85M/F92L, E35D/M38T/M43V/M47V/N48R/L85Q, T28Y/Q33H/E35D/D46V/M47I/A71G, E35D/N48K/L72V, E35D/T41S/N48T, D46V/M47I/A71G, M47I/A71G, E35D/M43I/M47L/L85M, E35D/M43I/D46E/A71G/L85M, H18Y/E35D/M47L/A71G/A91S, E35D/M47I/N48K/I61F, E35D/M47V/T62S/L85Q, M43I/M47L/A71G, E35D/M47V, E35D/M47L/A71G/L85M, V22A/E35D/M47L/A71G, E35D/M47L/A71G, E35D/D46E/M47I, Q27H/E35D/M47I, E35D/D46E/L85M, E35D/D46E/A91G, E35D/D46E, E35D/L97R, H18Y/E35D, Q27L/E35D/M47V/I61V/L85M, E35D/M47V/I61V/L85M, E35D/M47V/L85M/R94Q, E35D/M47V/N48K/L85M, H18Y/E35D/M47V/N48K, A26E/Q27R/E35D/M47L/N48Y/L85Q, E35D/D46E/M47L/V68M/L85Q/F92L, E35D/M47I/T62S/L85Q/E88D, E24D/Q27R/E35D/T41S/M47V/L85Q, S15T/H18Y/E35D/M47V/T62A/N64S/A71G/L85Q/D90N, E35D/M47L/V68M/A71G/L85Q/D90G, H18Y/E35D/M47I/V68M/A71G/R94L, Q33R/M47V/T62N/A71G, H18Y/V22A/E35D/T41S/M47V/T62N/A71G/A91G, E24D/E35D/M47L/V68M/E95V/L97Q, E35D/D46E/M47I/T62A/V68M/L85M/Y87C, E35D/D46E/M47I/V68M/L85M, E35D/D46E/M47L/V68M/A71G/Y87C/K93R, E35D/D46E/M47L/V68M/T79M/L85M, E35D/D46E/M47L/V68M/T79M/L85M/L97Q, E35D/D46E/M47V/V68M/L85Q, E35D/M43I/M47L/V68M, E35D/M47I/V68M/Y87N, E35D/M47L/V68M/E95V/L97Q, E35D/M47L/Y53F/V68M/A71G/K93R/E95V, E35D/M47V/N48K/V68M/A71G/L85M, E35D/M47V/N48K/V68M/L85M, E35D/M47V/V68M/L85M, E35D/M47V/V68M/L85M/Y87D, E35D/T41S/D46E/M47I/V68M/K93R/E95V, H18Y/E35D/D46E/M47I/V68M/R94L, H18Y/E35D/D46E/M47I/V68M/R94L, H18Y/E35D/M38I/M47L/V68M/L85M, H18Y/E35D/M47I/V68M/Y87N, H18Y/E35D/M47I/V68M/Y87N, H18Y/E35D/M47L/V68M/A71G/L85M, H18Y/E35D/M47L/V68M/A71G/L85M, H18Y/E35D/M47L/V68M/E95V/L97Q, H18Y/E35D/M47L/V68M/E95V/L97Q, H18Y/E35D/M47L/Y53F/V68M/A71G, H18Y/E35D/M47L/Y53F/V68M/A71G, H18Y/E35D/M47L/Y53F/V68M/A71G/K93R/E95V, H18Y/E35D/M47L/Y53F/V68M/A71G/K93R/E95V, H18Y/E35D/M47V/V68M/L85M, H18Y/E35D/M47V/V68M/L85M, H18Y/E35D/V68M/A71G/R94Q/E95V, H18Y/E35D/V68M/A71G/R94Q/E95V, H18Y/E35D/V68M/L85M/R94Q, H18Y/E35D/V68M/L85M/R94Q, H18Y/E35D/V68M/T79M/L85M, H18Y/V22D/E35D/M47V/N48K/V68M, Q27L/Q33L/E35D/T41S/M47V/N48K/V68M/L85M, Q33L/E35D/M47V/T62S/V68M/L85M, Q33R/E35D/M38I/M47L/V68M, R29C/E35D/M47L/V68M/A71G/L85M, S21P/E35D/K37E/D46E/M47I/V68M, S21P/E35D/K37E/D46E/M47I/V68M/R94L, T13R/E35D/M47L/V68M, T13R/Q27L/Q33L/E35D/T41S/M47V/N48K/V68M/L85M, T13R/Q33L/E35D/M47L/V68M/L85M, T13R/Q33L/E35D/M47V/T62S/V68M/L85M, T13R/Q33R/E35D/M38I/M47L/V68M, T13R/Q33R/E35D/M38I/M47L/V68M/E95V/L97Q, T13R/Q33R/E35D/M38I/M47L/V68M/L85M, T13R/Q33R/E35D/M38I/M47L/V68M/L85M/R94Q, T13R/Q33R/E35D/M47L/V68M, T13R/Q33R/E35D/M47L/V68M/L85M, V22D/E24D/E35D/M47L/V68M, V22D/E24D/E35D/M47L/V68M/L85M/D90G, V22D/E24D/E35D/M47V/V68M, H18Y/E35D/M47V/V68M/A71G, H18C/A26P/E35D/M47L/V68M/A71G, H181/A26P/E35D/M47V/V68M/A71G, H18L/A26N/D46E/V68M/A71G/D90G, H18L/E35D/M47V/V68M/A71G/D90G, H18T/A26N/E35D/M47L/V68M/A71G, H18V/A26K/E35D/M47L/V68M/A71G, H18V/A26N/E35D/M47V/V68M/A71G, H18V/A26P/E35D/M47V/V68L/A71G, H18V/A26P/E35D/M47L/V68M/A71G, H18V/E35D/M47V/V68M/A71G/D90G, H18Y/A26P/E35D/M47I/V68M/A71G, H18Y/A26P/E35D/M47V/V68M/A71G, H18Y/E35D/M47V/V68L/A71G/D90G, H18Y/E35D/M47V/V68M/A71G/D90G, A26P/E35D/M47I/V68M/A71G/D90G, H18V/A26G/E35D/M47V/V68M/A71G/D90G, H18V/A26S/E35D/M47L/V68M/A71G/D90G, H18V/A26R/E35D/M47L/V68M/A71G/D90G, H18V/A26D/E35D/M47V/V68M/A71G/D90G, H18V/A26Q/E35D/M47V/V68L/A71G/D90G, H18A/A26P/E35D/M47L/V68M/A71G/D90G, H18A/A26N/E35D/M47L/V68M/A71G/D90G, H18F/A26P/E35D/M47I/V68M/A71G/D90G, H18F/A26H/E35D/M47L/V68M/A71G/D90G, H18F/A26N/E35D/M47V/V68M/A71G/D90K, H18Y/A26N/E35D/M47F/V68M/A71G/D90G, H18Y/A26P/E35D/M47Y/V681/A71G/D90G, H18Y/A26Q/E35D/M47T/V68M/A71G/D90G, H18R/A26P/E35D/D46N/M47V/V68M/A71G/D90P, and H18F/A26D/E35D/D46E/M47T/V68M/A71G/D90G.

248. The method of any of embodiments 215-247, wherein the variant CD80 polypeptide retains binding to CD28.

249. The method of embodiment 248, wherein the variant CD80 polypeptide retains at least or at least about 2%, 3%, 4%, 5%, 6%, 7%, 8,%, 9%, 10%, 12%, 15%, 20%, 25%, 30%, 35%, 40%, 50%, 55%, 60%, 65%, 70% 75%, 80%, 85%, 90%, or 95% of the affinity to the ectodomain of CD28, compared to the binding affinity of the unmodified CD80 polypeptide for the ectodomain of CD28.

250. The method of any of embodiments 215-249, wherein the variant CD80 polypeptide exhibits increased binding affinity to the ectodomain of CD28 compared to the binding affinity of the unmodified CD80 for the ectodomain of CD28.

251. The method of embodiment 250, wherein the increased affinity to the ectodomain of CD28 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100-fold, 150-fold, or 200-fold, compared to binding affinity of the unmodified CD80 for the ectodomain of CD28.

252. The method of any of embodiments 219-251, wherein increasing the immune response treats the disease or condition in the subject.

253. The method of any of embodiments 219-252, wherein the disease or condition is a tumor or cancer.

254. The method of any of embodiments 219-253, wherein the disease or condition is selected from melanoma, lung cancer, bladder cancer, a hematological malignancy, liver cancer, brain cancer, renal cancer, breast cancer, pancreatic cancer, colorectal cancer, spleen cancer, prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer.

255. A method of detecting a CD80 binding partner in a biological sample, the method comprising:

(a) contacting a biological sample with a binding reagent comprising a variant CD80 polypeptide of any of claims 1-71; and (b) detecting the presence of the bound binding reagent in or on cells of the biological sample.

256. The method of embodiment 255, wherein the binding partner is PD-L1, CD28, CTLA-4 or combinations thereof.

257. The method of embodiment 255 or embodiment 256, wherein the variant CD80 polypeptide comprises one or more amino acid modifications at one or more positions in the IgV domain or IgC domain or the specific binding fragment thereof of an unmodified CD80 or specific binding fragment thereof, wherein the variant CD80 polypeptide exhibits increased binding affinity to the ectodomain of PD-L1 compared to the binding affinity of the unmodified CD80 for the ectodomain of PD-L1.

258. The method of any of embodiments 255-257, wherein the biological sample is or comprises a body fluid, cell or tissue sample.

259. The method of embodiment 258, wherein the body fluid is serum, plasma or urine.

260. The method of embodiment 258, wherein the tissue sample is a tumor tissue sample.

261. The method of embodiment 260, wherein the tumor tissue sample comprises tumor infiltrating immune cells, tumor cells, stromal cells, or any combination thereof.

262. The method of any of embodiments 255-261, wherein the variant CD80 polypeptide comprises the IgV domain or a specific binding fragment thereof.

263. The method of embodiment 262, wherein the IgV domain or specific binding fragment thereof is the only CD80 portion of the binding reagent.

264. The method of any of embodiments 255-263, wherein the binding reagent is linked, directly or indirectly, to a label that is a detectable moiety or to a moiety capable of detection.

265. The method of embodiment 264, wherein the moiety is an Fc region.

266. The method of embodiment 265, wherein the Fc region is non-human, optionally is mouse or rabbit.

267. The method of any of embodiments 255-266, wherein detecting the presence of bound binding reagent is by immunohistochemistry, pseudo-immunohistochemistry, immunofluorescence, flow cytometry, ELISA or immunoblotting.

IX. EXAMPLES

The following examples are included for illustrative purposes only and are not intended to limit the scope of the invention.

Example 1

Generation of Mutant DNA Constructs of IgSF Domains

Example 1 Describes the Generation of Mutant DNA Constructs of Human CD80 IgSF domains for translation and expression on the surface of yeast as yeast display libraries.

A. Degenerate Libraries

Constructs were generated based on a wildtype human CD80 sequence set forth in SEQ ID NO:3031, containing the immunoglobulin-like V-type (IgV) domain as follows:

```
                                          (SEQ ID NO: 3031)
VIHVTKEVKEVATLSCGHNVSVEELAQTRIYWQKEKKMVLTMMSGDMNI

WPEYKNRTIFDITNNLSIVILALRPSDEGTYECVVLKYEKDAFKREHLA

EVTLSVKAD
```

For libraries that target specific residues for complete or partial randomization with degenerate codons, degenerate codons, such as specific mixed base sets to code for various amino acid substitutions, were generated using an algorithm at the URL: rosettadesign.med.unc.edu/SwiftLib/. In general, positions to mutate were chosen from crystal structure information for CD80 bound to CTLA4 at the URL: resb.org/pdb/explore/explore.do?structureId=18L, and a targeted library was designed based on the CD80::CTLA4 interface for selection of improved binders to CTLA4. For example, the structural information was used to identify contact or non-contact interface residues for mutagenesis with degenerate codons. This analysis was performed using a structure viewer available at the URL: spdbv.vital-it.ch.

The next step in library design was the alignment of human, mouse, rat, and monkey CD80 sequences to identify which of the residues chosen for mutagenesis were conserved residues. Based on this analysis, conserved target residues were mutated with degenerate codons that only specified conservative amino acid changes plus the wild-type residue. Residues that were not conserved were mutated more aggressively, but also included the wild-type residue. Degenerate codons that also encoded the wild-type residue were deployed to avoid excessive mutagenesis of target protein. For the same reason, only up to 20 positions were targeted for mutagenesis for each library. Mutational analysis was focused on contact and non-contact interfacial residues that were within 6 Å of the binding surface with their side chains directed toward the ligand/counter structure.

To generate DNA encoding the targeted library, overlapping oligos of up to 80 nucleotides in length and containing degenerate codons at the residue positions targeted for mutagenesis, were ordered from Integrated DNA Technologies (Coralville, USA). The oligonucleotides were dissolved in sterile water, mixed in equimolar ratios, heated to 95° C. for five minutes and slowly cooled to room temperature for annealing. IgV domain-specific oligonucleotide primers that anneal to the start and end of the IgV domain gene sequence were then used to generate PCR product. IgV domain-specific oligonucleotides which overlap by 40 bp with pBYDS03 cloning vector (Life Technologies, USA), beyond and including the BamHI and KpnI cloning sites, were then used to amplify 100 ng of PCR product from the prior step to generate a total of at least 12 μg of DNA for every electroporation. Both polymerase chain reactions (PCRs) used OneTaq 2×PCR master mix (New England Biolabs, USA). The products from the second PCR were purified using a PCR purification kit (Qiagen, Germany) and resuspended in sterile deionized water. Alternatively, Ultramers® (Integrated DNA Technologies) of up to 200 bp in length were used in conjunction with megaprimer PCR (URL: http://www.ncbi.nlm.nih.gov/pmc/articles/PMC146891/pdf/253371.pdf) to generate larger stretches of degenerate codons that could not be as easily incorporated using multiple small overlapping primers. Following the generation of full length product using megaprimer PCR, the mutant IgV domain library was PCR amplified again using DNA primers containing 40 bp overlap region with pBYDS03 cloning variant for homologous recombination into yeast.

To prepare for library insertion, pBYDS03 vector was digested with BamHI and KpnI restriction enzymes (New England Biolabs, USA) and the large vector fragment was gel-purified and dissolved in sterile, deionized water. Electroporation-ready DNA for the next step was generated by mixing 12 μg of library DNA insert with 4 μg of linearized vector in a total volume of 50 μL deionized and sterile water. An alternative method to generate targeted libraries, is to carry out site-directed mutagenesis (Multisite kit, Agilent, USA) of the target IgV domain with oligonucleotides containing degenerate codons. This approach is used to generate sublibraries that only target a few specific stretches of DNA for mutagenesis. In these cases, sublibraries are mixed before proceeding to the selection steps. In general, library sizes were in the range of 10E7 to 10E8 clones, except that sublibraries were only in the range of 10E4 to 10E5.

B. Random Libraries

Random libraries were also constructed to identify variants of the IgV domain of CD80 set forth in SEQ ID NO:3031 (containing the IgV domain). DNA encoding the wild-type CD80 IgV domain was cloned between the BamHI and KpnI sites of yeast display vector pBYDS03 and then released using the same restriction enzymes. The released DNA was then mutagenized with the Genemorph II Kit (Agilent Genomics, USA) to generate an average of three to five amino acid changes per library variant. Mutagenized DNA was then amplified by the two-step PCR and further processed as described above for targeted libraries.

After completing several rounds of selection using beads and iterative FACS, a pool of clones were further mutated via error prone PCR. Thus, a second generation mutant library was created following the steps outlined as above though using selection output DNA as template rather than wildtype IgV plasmid sequence as template.

Example 2

Introduction of DNA Libraries into Yeast

To introduce degenerate and random CD80 library DNA into yeast, electroporation-competent cells of yeast strain BJ5464 (ATCC.org; ATCC number 208288) were prepared and electroporated on a Gene Pulser II (Biorad, USA) with the electroporation-ready DNA from the steps above essentially as described (Colby, D. W. et al. 2004 Methods Enzymology 388, 348-358). The only exception was that transformed cells were grown in non-inducing minimal selective SCD-Leu medium to accommodate the LEU2 selective marker carried by modified plasmid pBYDS03. One liter of SCD-Leu media consists of 14.7 grams of sodium citrate, 4.29 grams of citric acid monohydrate, 20 grams of dextrose, 6.7 grams of yeast nitrogen base, and 1.6 grams yeast synthetic drop-out media supplement without leucine. The Medium was filter sterilized before use, using a 0.22 m vacuum filter device.

Library size was determined by plating dilutions of freshly recovered cells on SCD-Leu agar plates and then extrapolating library size from the number of single colonies from plating that generated at least 50 colonies per plate. The remainder of the electroporated culture was grown to saturation and cells from this culture were subcultured 1/100 into the same medium once more and grown to saturation to minimize the fraction of untransformed cells and to allow for segregation of plasmid from cells that may contain two or more library variants. To maintain library diversity, this subculturing step was carried out using an inoculum that contained at least 10× more cells than the calculated library size. Cells from the second saturated culture were resuspended in fresh medium containing sterile 25% (weight/volume) glycerol to a density of 10E10/mL and frozen and stored at −80° C. (frozen library stock).

Example 3

Yeast Selection

Example 3 describes the selection of yeast cells expressing affinity-modified variants of CD80. It has been well-established that CTLA4 binding to CD80 antagonizes CD28 binding to CD80 (Schwartz J. C. et al. Nature 410, 604-08, 2001). To identify CD80 mutants that selectively bind CTLA4 over CD28, cells from the CD80 mutant libraries were subjected to iterative rounds of positive and negative FACS sorting and mutagenesis.

A number of cells equal to at least 10 times the estimated library size were thawed from individual library stocks, suspended to 1.0×10E6 cells/mL in non-inducing SCD-Leu medium, and grown overnight. The next day, a number of cells equal to 10 times the library size were centrifuged at 2000 RPM for two minutes and resuspended to 0.5×10E6 cells/mL in inducing SCDG-Leu media. One liter of SCDG-Leu induction media consists of 5.4 grams $Na_2HPO_4$, 8.56 grams $NaH_2PO_4.H_2O$, 20 grams galactose, 2.0 grams dextrose, 6.7 grams yeast nitrogen base, and 1.6 grams yeast synthetic drop out media supplement without leucine dissolved in water and sterilized through a 0.22 m membrane filter device. The culture was grown in induction medium for 1 day at room temperature to induce expression of library proteins on the yeast cell surface.

Cells were sorted twice using Protein A magnetic beads (New England Biolabs, USA) loaded with cognate ligand to reduce non-binders and enrich for all CD80 variants with the ability to bind their exogenous recombinant counter-structure proteins. This was then followed by multiple rounds of fluorescence activated cell sorting (FACS) using exogenous counter-structure protein staining to enrich the fraction of yeast cells that displays improved binding to CTLA4-Fc (R&D Systems, USA). These positive selections were alternated with negative FACS selections to remove CD80 clones that bound to CD28-Fc. Magnetic bead enrichment and selections by flow cytometry were carried out essentially as described in Miller K. D., et al., Current Protocols in Cytometry 4.7.1-4.7.30, July 2008.

With CD80 libraries, target ligand proteins were employed as follows: internally produced human rCTLA4-Fc, human rCD28-Fc, and human rPD-L1 (R&D Systems, Minneapolis, USA). Magnetic Protein A beads were obtained from New England Biolabs, USA. For two-color, flow cytometric sorting, a Bio-Rad S3e sorter was used. CD80 display levels were monitored with an anti-hemagglutinin (HA) antibody labeled with Alexafluor 488 (Life Technologies, USA). Ligand binding of Fc fusion proteins, rCTLA4Fc, rPD-L1 or rCD28Fc, were detected with PE conjugated human Ig specific goat Fab (Jackson ImmunoResearch, USA). Doublet yeast were gated out using forward scatter (FSC)/side scatter (SSC) parameters, and sort gates were based upon higher ligand binding detected in FL2 that possessed more limited tag expression binding in FL1.

Yeast outputs from the flow cytometric sorts were assayed for higher specific binding affinity. Sort output yeast were expanded and re-induced to express the particular IgSF affinity modified domain variants they encode. This population then can be compared to the parental, wild-type yeast strain, or any other selected outputs, such as the bead output yeast population, by flow cytometry.

For CD80, the second FACS outputs (F2) were compared to parental CD80 yeast for binding rCTLA4Fc, rPD-L1, or rCD28Fc by double staining each population with anti-HA (hemagglutinin) tag expression and the anti-human Fc secondary to detect ligand binding.

Selected variant CD80 IgV domains were further formatted as fusion proteins and tested for binding and functional activity as described below.

Example 4

Reformatting Selection Outputs as Fc-Fusions and in Various Immunomodulatory Protein Types Example 4 describes reformatting of selection outputs identified in Example 3 as immunomodulatory proteins containing an affinity modified (variant) immunoglobulin-like V-type (IgV) domain of CD80 fused to an Fc molecule (variant IgV domain-Fc fusion molecules).

Output cell pools from final flow cytometric CD80 sorts were grown to terminal density in SCD-Leu medium. Plasmid DNA from each output was isolated using a yeast plasmid DNA isolation kit (Zymoresearch, USA). For Fc fusions, PCR primers with added restriction sites suitable for cloning into the Fc fusion vector of choice were used to batch-amplify from the plasmid DNA preps the coding DNA for the mutant target IgV domains After restriction digestion, the PCR products were ligated into Fc fusion vector followed by heat shock transformation into *E. coli* strain XL1 Blue (Agilent, USA) or NEB5alpha (New England Biolabs) as directed by supplier. Alternatively, the outputs were PCR amplified with primers containing 40 bp overlap regions on either end with Fc fusion vector to carry out in vitro recombination using Gibson Assembly Mastermix (New England Biolabs), which was subsequently used in heat shock transformation into *E. coli* strain NEB5alpha. Exemplary of an Fc fusion vector is pFUSE-hIgG1-Fc2 (InvivoGen, USA).

Dilutions of transformation reactions were plated on LB-agar containing 100 μg/mL carbenicillin (Teknova, USA) to isolate single colonies for selection. Up to 96 colonies from each transformation were then grown in 96 well plates to saturation overnight at 37° C. in LB-carbenicillin broth (Teknova cat #L8112) and a small aliquot from each well was submitted for DNA sequencing of the IgV domain insert in order to identify the mutation(s) in all clones. Sample preparation for DNA sequencing was carried out using protocols provided by the service provider (Genewiz; South Plainfield, N.J.). After removal of sample for DNA sequencing, glycerol was then added to the remaining cultures for a final glycerol content of 25% and plates were stored at −20° C. for future use as master plates (see below). Alternatively, samples for DNA sequencing were generated by replica plating from grown liquid cultures onto solid agar plates using a disposable 96 well replicator (VWR, USA). These plates were incubated overnight to generate growth patches and the plates were submitted to Genewiz as specified by Genewiz.

After identification of clones of interest from analysis of Genewiz-generated DNA sequencing data, clones of interest were recovered from master plates and individually grown to density in liquid LB-broth containing 100 μg/mL carbenicillin (Teknova, USA) and cultures were then used for preparation of plasmid DNA of each clone using a standard kit such as the PureYield Plasmid Miniprep System (Promega) or the MidiPlus kit (Qiagen). Identification of clones of interest from Genewiz sequencing data generally involved the following steps. First, DNA sequence data files were downloaded from the Genewiz website. All sequences were then manually curated so that they start at the beginning of the IgV domain coding region. The curated sequences were then batch-translated using a suitable program available at the URL: www.ebi.ac.uk/Tools/st/emboss_transeq/. The translated sequences were then aligned using a suitable program available at the URL: multalin.toulouse.inra.fr/multalin/multalin.html. Alternatively, Genewiz sequenced were processed to generate alignments using Ugene software (http://ugene.net).

Clones of interest were then identified from alignments using the following criteria: 1) identical clone occurs at least two times in the alignment and 2) a mutation occurs at least two times in the alignment and preferably in distinct clones. Clones that meet at least one of these criteria were assumed to be clones that have been enriched by the sorting process due to improved binding.

To generate recombinant immunomodulatory proteins that are Fc fusion proteins containing an IgV domain of CD80 with at least one affinity-modified domain (e.g. variant CD80 IgV-Fc), the DNA encoding the variant was generated to encode a protein as follows: variant (mutant) CD80 IgV domain followed by a linker of three alanines (AAA) followed by an inert Fc lacking effector function, set forth in SEQ ID NO: 1713, containing the mutations C220S, R292C, N297G and V302C by EU numbering (corresponding to C5S, R77C, N82G and V87C with reference to wild-type human IgG1 Fc set forth in SEQ ID NO: 277); or 1714, containing the mutations C220S, L234A, L235E and G237A by EU numbering. Alternatively, CD80 IgV domains were fused in a similar manner but with a linker containing the amino acids (GSGGGGS; SEQ ID NO: 1716) followed by an inert Fc lacking effector function, set forth in SEQ ID NO: 1714. In some cases, CD80 IgV domains were fused in a similar manner but with a human IgG1 Fc capable of effector activity (effector). Since the construct does not include an antibody, light chains that can form a covalent bond with a cysteine, such an exemplary human IgG1 Fc (set forth in SEQ ID NO: 1429) contained a replacement of the cysteine residue to a seine residue at position 220 (C220S) by EU numbering (corresponding to position 5 (C5S) with reference to the wild-type or unmodified Fc set forth in SEQ ID NO: 277).

Example 5

Expression and Purification of Fc-Fusions

Example 5 describes the high throughput expression and purification of Fc-fusion proteins containing variant IgV CD80 as described in the above Examples.

Recombinant variant Fc fusion proteins were produced from suspension-adapted human embryonic kidney (HEK) 293 cells using the Expi293 expression system (Invitrogen, USA). 4 μg of each plasmid DNA from the previous step was added to 200 μL Opti-MEM (Invitrogen, USA) at the same time as 10.8 μL ExpiFectamine was separately added to another 200 μL Opti-MEM. After 5 minutes, the 200 μL of plasmid DNA was mixed with the 200 μL of ExpiFectamine and was further incubated for an additional 20 minutes before adding this mixture to cells. Ten million Expi293 cells were dispensed into separate wells of a sterile 10 mL, conical bottom, deep 24-well growth plate (Thomson Instrument Company, USA) in a volume of 4 mL Expi293 media (Invitrogen, USA). Plates were shaken for 5 days at 120 RPM in a mammalian cell culture incubator set to 95% humidity and 8% $CO_2$. Following a 5-day incubation, cells were pelleted and culture supernatants were retained.

Proteins were purified from supernatants using a high throughput 96-well Filter Plate (Thomson Catalog number 931919), each well loaded with 60 μL of Mab SelectSure settled bead (GE Healthcare cat. no. 17543801). Protein was eluted with four consecutive 200 μl fractions of 50 mM Acetate pH 3.3. Each fraction's pH was adjusted to above pH 5.0 with 4 μL 2 M Tris pH 8.0. Fractions were pooled and quantitated using 280 nm absorbance measured by Nanodrop instrument (Thermo Fisher Scientific, USA), and protein purity was assessed by loading 5 g of non-reduced protein on Mini-Protean TGX Stain-Free gels. Proteins were then visualized on a Bio Rad Chemi Doc XRS gel imager.

Example 6

Assessment of Binding of Affinity-Matured IgSF Domain-Containing Molecules

This Example describes Fc-fusion binding studies of purified proteins from the above Examples to cell-expressed CTLA4, PD-L1, and CD28 counter structures to assess the specificity and affinity of CD80 domain variant immunomodulatory proteins. Full-length mammalian surface expression constructs for each of human CTLA4, PD-L1, and CD28, were designed in pcDNA3.1 expression vector (Life Technologies) and sourced from Genscript, USA. Binding studies were carried out on transfected HEK293 cells generated to express the full-length mammalian surface ligands using the using the Expi293F transient transfection system (Life Technologies, USA). As a control, binding to mock (non-transfected) cells also was assessed. The number of cells needed for the experiment was determined, and the appropriate 30 mL scale of transfection was performed using the manufacturer's suggested protocol. For each CTLA4, PD-L1, CD-28 or mock 30 mL transfection, 75 million Expi293F cells were incubated with 30 μg expression construct DNA and 1.5 mL diluted ExpiFectamine 293 reagent for 48 hours, at which point cells were harvested for staining.

For staining and analysis by flow cytometry, 100,000 cells of appropriate transient transfection or negative control (mock) were plated in 96-well round bottom plates. Cells were spun down and resuspended in staining buffer (PBS (phosphate buffered saline), 1% BSA (bovine serum albumin), and 0.1% sodium azide) for 20 minutes to block non-specific binding. Afterwards, cells were centrifuged and resuspended in staining buffer containing 200 nM to 91 pM of each candidate variant CD80 Fc, depending on the experiment of each candidate variant CD80 Fc protein in 50 μl. As controls, the binding activities of wild-type CD80-ECD-Fc (R&D Systems), wild-type CD80-ECD-Fc (inert), wild-type IgV-Fc (inert) and/or human IgG (Sigma) were also assessed. Primary staining was performed on ice for 45 minutes, before washing cells in staining buffer twice. PE-conjugated anti-human Fc (Jackson ImmunoResearch, USA) was diluted 1:150 in 50 μL staining buffer and added to cells and incubated another 30 minutes on ice. Secondary antibody was washed out twice, cells were fixed in 4% formaldehyde/PBS, and samples were analyzed on Intellicyt flow cytometer (Intellicyt Corp, USA). Mean Fluorescence Intensity (MFI) was calculated for each transfectant and mock transfected HEK293 with FlowJo Version 10 software (FlowJo LLC, USA).

Results for two binding studies for exemplary CD80 variants are shown in Tables 10 and 11. In the Tables. The exemplary amino acid substitutions are designated by amino acid position number corresponding to numbering of the respective reference unmodified ECD sequence. For example, the reference unmodified ECD sequence is the unmodified CD80 ECD sequence set forth in SEQ ID NO: 2. The amino acid position is indicated in the middle, with the corresponding unmodified (e.g., wild-type) amino acid listed before the number and the identified variant amino acid substitution listed after the number. The second column sets forth the SEQ ID NO identifier for the variant IgV for each variant IgV-Fc fusion molecule.

Also shown is the binding activity as measured by the Mean Fluorescence Intensity (MFI) value for the binding of each variant CD80 Fc-fusion molecule to cells engineered to express the indicated cognate counter structure ligand (i.e., CTLA-4, PD-L1, or CD28) and the ratio of the MFI of the variant CD80 IgV-Fc, compared to the binding of the corresponding unmodified CD80 IgV-Fc fusion molecule not containing the amino acid substitution(s), to the same cell-expressed counter structure ligand. The ratio of the binding of the variant CD80IgV-Fc to the CTLA-4 counter structure ligand compared to the binding of the variant CD80IgV-Fc to the CD28 counter structure ligand also is shown in the last column of the Tables.

As shown in Tables 10 and 11, the selections resulted in the identification of a number of CD80 IgV domain variants that were affinity-modified to exhibit increased binding for CTLA-4 and/or PD-L1 counter structure ligand(s). In addition, the results indicate that a number of variants were selected that exhibit reduced binding to CD28, including several CD80 IgV domain variants that exhibit increased binding to the CTLA-4 counter structure ligand compared to the CD28 counter structure ligand (Ratio of CTLA4:CD28).

TABLE 10

Variant CD80 Binding to HEK293 Cells Transfected with CTLA4, CD28 or PD-L1

| CD80 mutation(s) | SEQ ID NO (IgV) | CTLA4 MFI at 66.6 nM | CTLA4 Fold change to WT | CD28 MFI at 66.6 nM | CD28 Fold change to WT | PD-L1 MFI at 22.2 nM | PD-L1 Fold change to WT | Ratio of CTLA4: CD28 |
|---|---|---|---|---|---|---|---|---|
| L70P | 151 | | | | Not tested | | | |
| I30F/L70P | 152 | | | | Not tested | | | |
| Q27H/T41S/A71D | 153 | 368176 | 2.3 | 25051 | 1.01 | 24181 | N/A | 14.7 |
| I30T/L70R | 154 | 2234 | 0.0 | 2596 | 0.10 | 5163 | N/A | 0.9 |
| T13R/C16R/L70Q/A71D | 155 | 197357 | 1.2 | 16082 | 0.65 | 9516 | N/A | 12.3 |
| T57I | 156 | 393810 | 2.4 | 23569 | 0.95 | 3375 | N/A | 16.7 |
| M43I/C82R | 157 | 3638 | 0.0 | 3078 | 0.12 | 7405 | N/A | 1.2 |
| V22L/M38V/M47T/A71D/L85M | 158 | 175235 | 1.1 | 3027 | 0.12 | 6144 | N/A | 57.9 |
| I30V/T57I/L70P/A71D/A91T | 159 | 116085 | 0.7 | 10129 | 0.41 | 5886 | N/A | 11.5 |
| V22I/L70M/A71D | 160 | 163825 | 1.0 | 22843 | 0.92 | 33404 | N/A | 7.2 |
| N55D/L70P/E77G | 161 | | | | Not tested | | | |
| T57A/I69T | 162 | | | | Not tested | | | |
| N55D/K86M | 163 | 3539 | 0.0 | 3119 | 0.13 | 5091 | N/A | 1.1 |
| L72P/T79I | 164 | 50176 | 0.3 | 3397 | 0.14 | 6023 | N/A | 14.8 |
| L70P/F92S | 165 | 4035 | 0.0 | 2948 | 0.12 | 6173 | N/A | 1.4 |
| T79P | 166 | 2005 | 0.0 | 2665 | 0.11 | 4412 | N/A | 0.8 |
| E35D/M47I/L65P/D90N | 167 | 4411 | 0.0 | 2526 | 0.10 | 4034 | N/A | 1.7 |
| L25S/E35D/M47I/D90N | 168 | 61265 | 0.4 | 4845 | 0.20 | 20902 | N/A | 12.6 |
| A71D | 170 | 220090 | 1.4 | 16785 | 0.68 | 29642 | N/A | 13.1 |
| E81K/A91S | 172 | 98467 | 0.6 | 3309 | 0.13 | 44557 | N/A | 29.8 |
| A12V/M47V/L70M | 173 | 81616 | 0.5 | 7400 | 0.30 | 31077 | N/A | 11.0 |
| K34E/T41A/L72V | 174 | 88982 | 0.6 | 3755 | 0.15 | 35293 | N/A | 23.7 |
| T41S/A71D/V84A | 175 | 103010 | 0.6 | 5573 | 0.22 | 83541 | N/A | 18.5 |
| E35D/A71D | 176 | 106069 | 0.7 | 18206 | 0.73 | 40151 | N/A | 5.8 |
| E35D/M47I | 177 | 353590 | 2.2 | 14350 | 0.58 | 149916 | N/A | 24.6 |
| K36R/G78A | 178 | 11937 | 0.1 | 2611 | 0.11 | 5715 | N/A | 4.6 |
| Q33E/T41A | 179 | 8292 | 0.1 | 2442 | 0.10 | 3958 | N/A | 3.4 |
| M47V/N48H | 180 | 207012 | 1.3 | 14623 | 0.59 | 145529 | N/A | 14.2 |
| M47L/V68A | 181 | 74238 | 0.5 | 13259 | 0.53 | 11223 | N/A | 5.6 |
| S44P/A71D | 182 | 8839 | 0.1 | 2744 | 0.11 | 6309 | N/A | 3.2 |
| Q27H/M43I/A71D/R73S | 183 | 136251 | 0.8 | 12391 | 0.50 | 8242 | N/A | 11.0 |
| E35D/T57I/L70Q/A71D | 185 | 121901 | 0.8 | 21284 | 0.86 | 2419 | N/A | 5.7 |
| M47I/E88D | 186 | 105192 | 0.7 | 7337 | 0.30 | 97695 | N/A | 14.3 |
| M42I/I61V/A71D | 187 | 54478 | 0.3 | 6074 | 0.24 | 4226 | N/A | 9.0 |
| P51A/A71D | 188 | 67256 | 0.4 | 4262 | 0.17 | 5532 | N/A | 15.8 |
| H18Y/M47I/T57I/A71G | 189 | 136455 | 0.8 | 20081 | 0.81 | 13749 | N/A | 6.8 |
| V20I/M47V/T57I/V84I | 190 | 183516 | 1.1 | 26922 | 1.08 | 3583 | N/A | 6.8 |
| WT CD80 ECD-Fc | 2 | 161423 | 1.0 | 24836 | 1.00 | Not tested | N/A | 6.5 |
| Fc only | | 5962 | | 2592 | | 4740 | | |

TABLE 11

Variant CD80 Binding to HEK293 Cells Transfected with CTLA4, CD28 or PD-L1

| CD80 mutation(s) | SEQ ID NO (IgV) | CTLA4 MFI at 66.6 nM | CTLA4 Fold change to WT | CD28 MFI at 66.6 nM | CD28 Fold change to WT | PD-L1 MFI at 22.2 nM | PD-L1 Fold change to WT | Ratio of CTLA4: CD28 |
|---|---|---|---|---|---|---|---|---|
| V20I/M47V/A71D | 191 | 149937 | 7.23 | 15090 | 9.33 | 9710 | 5.48 | 9.9 |
| A71D/L72V/E95K | 192 | 140306 | 6.77 | 6314 | 3.90 | 8417 | 4.75 | 22.2 |
| V22L/E35G/A71D/L72P | 193 | 152588 | 7.36 | 8150 | 5.04 | 1403 | 0.79 | 18.7 |
| E35D/A71D | 194 | 150330 | 7.25 | 14982 | 9.26 | 13781 | 7.77 | 10.0 |
| E35D/I67L/A71D | 195 | 146087 | 7.04 | 11175 | 6.91 | 9354 | 5.28 | 13.1 |
| T13R/M42V/M471/A71D | 197 | 108900 | 5.25 | 16713 | 10.33 | 1869 | 1.05 | 6.5 |
| E35D | 198 | 116494 | 5.62 | 3453 | 2.13 | 25492 | 14.38 | 33.7 |
| E35D/M47I/L70M | 199 | 116531 | 5.62 | 14395 | 8.90 | 49131 | 27.71 | 8.1 |
| E35D/A71/L72V | 200 | 134252 | 6.47 | 11634 | 7.19 | 13125 | 7.40 | 11.5 |
| E35D/M43L/L70M | 201 | 102499 | 4.94 | 3112 | 1.92 | 40632 | 22.92 | 32.9 |
| A26P/E35D/M43I/L85Q/E88D | 202 | 83139 | 4.01 | 5406 | 3.34 | 9506 | 5.36 | 15.4 |
| E35D/D46V/L85Q | 203 | 85989 | 4.15 | 7510 | 4.64 | 38133 | 21.51 | 11.4 |
| Q27L/E35D/M47I/T57I/L70Q/E88D | 204 | 59793 | 2.88 | 14011 | 8.66 | 1050 | 0.59 | 4.3 |
| Q27H/E35G/A71D/L72P/T79I | 196 | 85117 | 4.10 | 10317 | 6.38 | 1452 | 0.82 | 8.3 |
| M47V/169F/A71D/V83I | 205 | 76944 | 3.71 | 15906 | 9.83 | 3399 | 1.92 | 4.8 |

TABLE 11-continued

Variant CD80 Binding to HEK293 Cells Transfected with CTLA4, CD28 or PD-L1

| CD80 mutation(s) | SEQ ID NO (IgV) | CTLA4 MFI at 66.6 nM | CTLA4 Fold change to WT | CD28 MFI at 66.6 nM | CD28 Fold change to WT | PD-L1 MFI at 22.2 nM | PD-L1 Fold change to WT | Ratio of CTLA4: CD28 |
|---|---|---|---|---|---|---|---|---|
| E35D/T57A/A71D/L85Q | 206 | 85724 | 4.13 | 3383 | 2.09 | 1764 | 0.99 | 25.3 |
| H18Y/A26T/E35D/A71D/L85Q | 207 | 70878 | 3.42 | 6487 | 4.01 | 8026 | 4.53 | 10.9 |
| E35D/M47L | 208 | 82410 | 3.97 | 11508 | 7.11 | 58645 | 33.08 | 7.2 |
| E23D/M42V/M43I/158V/L70R | 209 | 37331 | 1.80 | 10910 | 6.74 | 2251 | 1.27 | 3.4 |
| V68M/L70M/A71D/E95K | 210 | 56479 | 2.72 | 10541 | 6.51 | 38182 | 21.53 | 5.4 |
| N55I/T57I/I69F | 211 | 2855 | 0.14 | 1901 | 1.17 | 14759 | 8.32 | 1.5 |
| E35D/M43I/A71D | 212 | 63789 | 3.08 | 6369 | 3.94 | 27290 | 15.39 | 10.0 |
| T41S/T57I/L70R | 213 | 59844 | 2.89 | 4902 | 3.03 | 19527 | 11.01 | 12.2 |
| H18Y/A71D/L72P/E88V | 214 | 68391 | 3.30 | 8862 | 5.48 | 1085 | 0.61 | 7.7 |
| V20I/A71D | 215 | 60323 | 2.91 | 10500 | 6.49 | 3551 | 2.00 | 5.7 |
| E23G/A26S/E35D/T62N/A71D/L72V/L85M | 216 | 59025 | 2.85 | 5484 | 3.39 | 10662 | 6.01 | 10.8 |
| A12T/E24D/E35D/D46V/I61V/L72P/E95V | 217 | 63738 | 3.07 | 7411 | 4.58 | 1221 | 0.69 | 8.6 |
| V22L/E35D/M43L/A71G/D76H | 218 | 2970 | 0.14 | 1498 | 0.93 | 1851 | 1.04 | 2.0 |
| E35G/K54E/A71D/L72P | 219 | 71899 | 3.47 | 3697 | 2.29 | 1575 | 0.89 | 19.4 |
| L70Q/A71D | 220 | 45012 | 2.17 | 18615 | 11.50 | 1692 | 0.95 | 2.4 |
| A26E/E35D/M47L/L85Q | 221 | 40325 | 1.94 | 2266 | 1.40 | 55548 | 31.33 | 17.8 |
| D46E/A71D | 222 | 69674 | 3.36 | 16770 | 10.36 | 22777 | 12.85 | 4.2 |
| Y31H/E35D/T41S/V68L/K93R/R94W | 223 | 3379 | 0.16 | 2446 | 1.51 | 18863 | 10.64 | 1.4 |
| WT CD80 IgV-Fc (inert) | 3031 | 20739 | 1.00 | 1618 | 1.00 | 1773 | 1.00 | 12.8 |
| WT CD80 ECD-Fc (inert) | 2 | 72506 | 3.50 | 3072 | 1.90 | 4418 | 2.49 | 23.6 |

Example 7

Selection of Additional Variant CD80 IgV Domains and Assessment of Binding Activity In order to refine affinity and functional potency of CD80 IgV variant interactions with counter structures CTLA4, CD28 and PDL1, second and third generations (Gen) of random mutagenesis and selection were run using procedures substantially described in Examples 1-3. Briefly, yeast plasmid DNA was isolated from outgrown yeast post FACS selection and used as template for mutagenic PCR. To maximize diversity, both characterized individual variants and a pool of FACS selected variants were used as template. The resulting library was subjected to iterative rounds of FACS selection and outgrowth. To increase PDL1 affinity while maintaining CD28 affinity, multiple FASC sort progression paths were taken. The second-generation mutagenic library underwent four FACS selections alternating between CD28− and CTLA4+ selections generating outputs that, when titrated against counter structures, were chosen to be reformatted into Fc vectors. The third-generation mutagenic library used the following FACS selection paths to yield yeast outputs that, when titrated against counter structures, were chosen to be reformatted into Fc vectors: 1. 50 nM PDL1+, 2a. 1 nM CTLA4+, 2b. 20 nM CTLA4−, 2a3, 10 nM PDL1+, 2b3. 10 nM PDL1+, 2b34. 25 nM CD28+. Following selection of yeast expressing affinity modified variants of CD80, the selected variants were reformatted as Fc fusion for the generation of additional Fc-fusion proteins containing IgV CD80 variants. After sequence analysis, individual variants were chosen for protein production, binding and functional assay. Variants from generation 1 mutagenesis are shown in Table 10, generation 2 shown in Table 11, generation 3 shown in Tables 12 and 13.

Binding of selected immunomodulatory fusion proteins to cognate binding partners was assessed. To produce cells expressing the CD80 cognate binding partners, huCTLA4 and huPD-L1, full-length mammalian surface expression constructs were generated, incorporated into lentivirus and transduced into CHO cells. Cells were sorted in a Bio-Rad S3 Cell Sorter (Bio-Rad Corp., USA) to >98% purity. Jurkat/IL2 reporter cells, which endogenously express CD28, were used to detect binding to CD28.

For staining and analysis by flow cytometry, 100,000 cells of appropriate transfected cells were plated in 96-well round bottom plates. Cells were spun down and resuspended in staining buffer (phosphate buffered saline (PBS), 1% bovine serum albumin (BSA), and 0.1% sodium azide) for 20 minutes to block non-specific binding. Afterwards, cells were centrifuged and resuspended in staining buffer containing a six-point serial dilution (concentrations ranged from 100 nM to 41 pM) of each candidate variant CD80-Fc protein in 50 μl. Primary staining was performed on ice for 45 minutes, before washing cells in staining buffer twice. Phycoerythrin (PE)-conjugated anti-human Fc (Jackson ImmunoResearch, USA) was diluted 1:150, added to cells and incubated another 30 minutes on ice. Cells were then washed twice with 150 μL/well stain buffer, fixed in 2% formaldehyde/PBS, and analyzed on Intellicyt flow cytometer (Intellicyt Corp., USA). PE Mean Fluorescence Intensity (MFI) was calculated for each cell type with FlowJo Version 10 software (FlowJo LLC, USA).

Results for two binding studies for exemplary CD80 variants are shown in Tables 12 and 13. In the Tables, the exemplary amino acid substitutions are designated by amino acid position number corresponding to numbering of the respective reference unmodified IgV sequence. For example, the reference unmodified ECD sequence is the unmodified CD80 ECD sequence set forth in SEQ ID NO:2. The amino acid position is indicated in the middle, with the corresponding unmodified (e.g., wild-type) amino acid listed before the number and the identified variant amino acid substitution listed after the number. The second column sets forth the SEQ ID NO identifier for the variant IgV for each variant IgV-Fc fusion molecule.

Also shown is the binding activity as measured by the Mean Fluorescence Intensity (MFI) value for the binding of 33 nM of each variant CD80 Fc-fusion molecule to cells engineered to express the indicated cognate counter structure ligand (i.e., CTLA-4, PD-L1, or CD28) and the ratio of the MFI of the variant CD80 IgV-Fc, compared to the binding of the unmodified CD80-ECD-Fc fusion molecule (R&D Systems, USA) not containing the amino acid substitution(s), to the same cell-expressed counter structure ligand. The ratio of the binding of the variant CD80 IgV-Fc to the PD-L1 counter structure compared to the binding of the variant CD80 IgV-Fc to the CD28 counter structure also is shown in the last column of the Tables.

As shown, the selections resulted in the identification of several CD80 IgV domain variants that were affinity-modified to exhibit increased binding for PD-L1 and/or CD28 counter structures. Several variants also retained or exhibited increased binding to CTLA-4, while others exhibited decreased binding to CTLA-4. In addition, the results indicate that a number of variants were selected that exhibit reduced binding to CD28, including several CD80 IgV domain variants that exhibit increased binding to the PD-L1 counter structure ligand compared to the CD28 counter structure ligand (Ratio of PD-L1:CD28). Thus, the variants have unique profiles for binding cell-surface CTLA4, CD28, and PD-L1 as measured by flow cytometry.

TABLE 12

Variant CD80 Flow Binding to Jurkat Cells (CD28) and CHO cells stably expressing CTLA4 or PD-L1

| | | CTLA4 | | CD28 | | PD-L1 | | |
|---|---|---|---|---|---|---|---|---|
| CD80 mutation(s) | SEQ ID NO (IgV) | MFI at 33.3 nM | Fold change to WT CD80 | MFI at 33.3 nM | Fold change to WT | MFI at 33.3 nM | Fold change to WT | Ratio of PDL1: CD28 |
| A26E/Q33R/E35D/M47L/L85Q/K86E | 2201 | 1275 | 0.01 | 275 | 0.04 | 75974 | 9.56 | 276 |
| A26E/Q33R/E35D/M47L/L85Q | 2202 | 1280 | 0.01 | 264 | 0.03 | 81533 | 10.26 | 309 |
| E35D/M47L/L85Q | 2203 | 336179 | 1.88 | 646 | 0.08 | 33200 | 4.18 | 51 |
| A26E/Q33L/E35D/M47L/L85Q | 2204 | 1172 | 0.01 | 274 | 0.04 | 62680 | 7.89 | 229 |
| A26E/Q33L/E35D/M47L | 2205 | 1316 | 0.01 | 271 | 0.04 | 60903 | 7.67 | 225 |
| H18Y/A26E/Q33L/E35D/M47L/L85Q | 2206 | 2088 | 0.01 | 272 | 0.04 | 76591 | 9.64 | 282 |
| Q33L/E35D/M47I | 2207 | 15919 | 0.09 | 282 | 0.04 | 37353 | 4.70 | 132 |
| H18Y/Q33L/E35D/M47I | 2208 | 5539 | 0.03 | 295 | 0.04 | 47793 | 6.02 | 162 |
| Q33L/E35D/D46E/M47I | 2209 | 23328 | 0.13 | 281 | 0.04 | 42137 | 5.30 | 150 |
| Q33R/E35D/D46E/M47I | 2210 | 3562 | 0.02 | 303 | 0.04 | 53345 | 6.72 | 176 |
| H18Y/E35D/M47L | 2211 | 284445 | 1.59 | 5068 | 0.66 | 44161 | 5.56 | 9 |
| Q33L/E35D/M47V | 2212 | 47648 | 0.27 | 281 | 0.04 | 47911 | 6.03 | 170 |
| Q33L/E35D/M47V/T79A | 2213 | 28899 | 0.16 | 285 | 0.04 | 62078 | 7.82 | 218 |
| Q33L/E35D/T41S/M47V | 2214 | 14515 | 0.08 | 287 | 0.04 | 43850 | 5.52 | 153 |
| Q33L/E35D/M47I/L85Q | 2215 | 20548 | 0.11 | 287 | 0.04 | 63930 | 8.05 | 222 |
| Q33L/E35D/M47I/T62N/L85Q | 2216 | 1658 | 0.01 | 284 | 0.04 | 72578 | 9.14 | 256 |
| Q33L/E35D/M47V/L85Q | 2217 | 75368 | 0.42 | 268 | 0.04 | 47438 | 5.97 | 177 |
| A26E/E35D/M43T/M47L/L85Q/R94Q | 2218 | 278021 | 1.56 | 260 | 0.03 | 68089 | 8.57 | 262 |
| Q33R/E35D/K37E/M47V/L85Q | 2219 | 22701 | 0.13 | 258 | 0.03 | 44438 | 5.59 | 172 |
| V22A/E23D/Q33L/E35D/M47V | 2220 | 3636 | 0.02 | 274 | 0.04 | 75513 | 9.51 | 275 |
| E24D/Q33L/E35D/M47V/K54R/L85Q | 2221 | 310964 | 1.74 | 3180 | 0.42 | 67066 | 8.44 | 21 |
| S15P/Q33L/E35D/M47L/L85Q | 2222 | 22377 | 0.13 | 266 | 0.03 | 51558 | 6.49 | 194 |
| E7D/E35D/M47I/L97Q | 2223 | 270798 | 1.52 | 273 | 0.04 | 14643 | 1.84 | 54 |
| Q33L/E35D/T41S/M43I | 2224 | 6388 | 0.04 | 433 | 0.06 | 44935 | 5.66 | 104 |
| E35D/M47I/K54R/L85E | 2225 | 8665 | 0.05 | 285 | 0.04 | 36917 | 4.65 | 130 |
| Q33K/E35D/D46V/L85Q | 2226 | 8507 | 0.05 | 257 | 0.03 | 26676 | 3.36 | 104 |
| Y31S/E35D/M47L/T79L/E88G | 2227 | 1095 | 0.01 | 278 | 0.04 | 38909 | 4.90 | 140 |
| H18L/V22A/E35D/M47L/N48T/L85Q | 2228 | 373548 | 2.09 | 434 | 0.06 | 98110 | 12.35 | 226 |
| Q27H/E35D/M47L/L85Q/R94Q/E95K | 2229 | 288596 | 1.61 | 282 | 0.04 | 36055 | 4.54 | 128 |
| Q33K/E35D/M47V/K89E/K93R | 2230 | 1752 | 0.01 | 276 | 0.04 | 39061 | 4.92 | 142 |
| E35D/M47I/E77A/L85Q/R94W | 2231 | 247334 | 1.38 | 272 | 0.04 | 64521 | 8.12 | 238 |
| A26E/E35D/M43I/M47L/L85Q/K86E/R94W | 2232 | 2947 | 0.02 | 314 | 0.04 | 49440 | 6.22 | 157 |
| Q27H/Q33L/E35D/M47V/N55D/L85Q/K89N | 2233 | 56061 | 0.31 | 269 | 0.04 | 14802 | 1.86 | 55 |
| H18Y/V20A/Q33L/E35D/M47V/Y53F | 2234 | 2878 | 0.02 | 260 | 0.03 | 120517 | 15.17 | 463 |
| V22A/E35D/V68E/A71D | 2235 | 437038 | 2.45 | 13987 | 1.83 | 1350 | 0.17 | 0 |
| Q33L/E35D/M47L/A71G/F92S | 2236 | 2107 | 0.01 | 366 | 0.05 | 28041 | 3.53 | 77 |
| V22A/R29H/E35D/D46E/M47I | 2237 | 77423 | 0.43 | 323 | 0.04 | 25407 | 3.20 | 79 |
| Q33L/E35D/M43I/L85Q/R94W | 2238 | 1083 | 0.01 | 272 | 0.04 | 29001 | 3.65 | 107 |
| H18Y/E35D/V68M/L97Q | 2239 | 172538 | 0.97 | 299 | 0.04 | 121591 | 15.31 | 407 |

TABLE 12-continued

Variant CD80 Flow Binding to Jurkat Cells (CD28) and CHO cells stably expressing CTLA4 or PD-L1

| CD80 mutation(s) | SEQ ID NO (IgV) | CTLA4 MFI at 33.3 nM | CTLA4 Fold change to WT CD80 | CD28 MFI at 33.3 nM | CD28 Fold change to WT | PD-L1 MFI at 33.3 nM | PD-L1 Fold change to WT | Ratio of PDL1: CD28 |
|---|---|---|---|---|---|---|---|---|
| Q33L/E35D/M47L/V68M/L85Q/E88D | 2240 | 3526 | 0.02 | 264 | 0.03 | 125741 | 15.83 | 476 |
| Q33L/E35D/M43V/M47I/A71G | 2241 | 13964 | 0.08 | 284 | 0.04 | 78029 | 9.82 | 275 |
| E35D/M47L/A71G/L97Q | 2242 | 225591 | 1.26 | 300 | 0.04 | 65944 | 8.30 | 220 |
| E35D/M47V/A71G/L85M/L97Q | 2243 | 239089 | 1.34 | 339 | 0.04 | 61708 | 7.77 | 182 |
| H18Y/Y31H/E35D/M47V/A71G/L85Q | 2244 | 3835 | 0.02 | 268 | 0.04 | 76364 | 9.61 | 285 |
| E35D/D46E/M47V/L97Q | 2245 | 305331 | 1.71 | 371 | 0.05 | 19484 | 2.45 | 52 |
| E35D/D46V/M47I/A71G/F92V | 2246 | 287194 | 1.61 | 7543 | 0.99 | 45755 | 5.76 | 6 |
| E35D/M47V/T62A/A71G/V83A/Y87H/L97M | 2247 | 18113 | 0.10 | 305 | 0.04 | 77547 | 9.76 | 255 |
| Q33L/E35D/N48K/L85Q/L97Q | 2248 | 1183 | 0.01 | 279 | 0.04 | 45185 | 5.69 | 162 |
| WT CD80 ECD-Fc (R & D) | 2 | 178708 | 1.00 | 7627 | 1.00 | 7943 | 1.00 | 1 |

TABLE 13

Variant CD80 Flow Binding to Jurkat Cells (CD28) and CHO cells stably expressing CTLA4 or PD-L1

| CD80 mutation(s) | SEQ ID NO (IgV) | CTLA4 MFI at 33.3 nM | CTLA4 Fold change to WT CD80 | CD28 MFI at 33.3 nM | CD28 Fold change to WT CD80 | PD-L1 MFI at 33.3 nM | PD-L1 Fold change to WT CD80 | Ratio of PDL1: CD28 |
|---|---|---|---|---|---|---|---|---|
| E35D/L85Q/K93T/E95V/L97Q | 2249 | 246401 | 1.57 | 400 | 0.02 | 19880 | 1.67 | 50 |
| E35D/M47V/N48K/V68M/K89N | 2250 | 807 | 0.01 | 11736 | 0.65 | 89775 | 7.56 | 8 |
| Q33L/E35D/M47I/N48D/A71G | 2251 | 116798 | 0.74 | 644 | 0.04 | 31151 | 2.62 | 48 |
| R29H/E35D/M43V/M47I/I49V | 2252 | 4694 | 0.03 | 336 | 0.02 | 1590 | 0.13 | 5 |
| Q27H/E35D/M47I/L85Q/D90G | 2253 | 257734 | 1.64 | 3513 | 0.19 | 30667 | 2.58 | 9 |
| E35D/M47I/L85Q/D90G | 2254 | 247703 | 1.57 | 4095 | 0.23 | 35710 | 3.01 | 9 |
| E35D/M47I/T62S/L85Q | 2255 | 300845 | 1.91 | 1758 | 0.10 | 44975 | 3.79 | 26 |
| A26E/E35D/M47L/A71G | 2256 | 341248 | 2.17 | 2161 | 0.12 | 53352 | 4.49 | 25 |
| E35D/M47I/Y87Q/K89E | 2257 | 110177 | 0.70 | 15452 | 0.86 | 29803 | 2.51 | 2 |
| V22A/E35D/M47I/Y87N | 2258 | 245711 | 1.56 | 15299 | 0.85 | 35251 | 2.97 | 2 |
| H18Y/A26E/E35D/M47L/L85Q/D90G | 2259 | 230588 | 1.47 | 3540 | 0.20 | 52390 | 4.41 | 15 |
| E35D/M47L/A71G/L85Q | 2260 | 156254 | 0.99 | 1436 | 0.08 | 50474 | 4.25 | 35 |
| E35D/M47V/A71G/E88D | 2261 | 211831 | 1.35 | 6237 | 0.35 | 37146 | 3.13 | 6 |
| E35D/A71G | 2262 | 184204 | 1.17 | 4299 | 0.24 | 34149 | 2.88 | 8 |
| E35D/M47V/A71G | 2263 | 226532 | 1.44 | 6360 | 0.35 | 36216 | 3.05 | 6 |
| I30V/E35D/M47V/A71G/A91V | 2264 | 204756 | 1.30 | 5779 | 0.32 | 43877 | 3.70 | 8 |
| V22D/E35D/M47L/L85Q | 2266 | 256426 | 1.63 | 542 | 0.03 | 34908 | 2.94 | 64 |
| H18Y/E35D/N48K | 2267 | 260795 | 1.66 | 4189 | 0.23 | 45849 | 3.86 | 11 |
| E35D/T41S/M47V/A71G/K89N | 2268 | 251238 | 1.60 | 5314 | 0.29 | 45436 | 3.83 | 9 |
| E35D/M47V/N48T/L85Q | 2269 | 281417 | 1.79 | 692 | 0.04 | 35491 | 2.99 | 51 |
| E35D/D46E/M47V/A71D/D90G | 2270 | 274661 | 1.75 | 6169 | 0.34 | 32371 | 2.73 | 5 |
| E35D/D46E/M47V/A71D | 2271 | 174016 | 1.11 | 5949 | 0.33 | 549 | 0.05 | 0 |
| E35D/T41S/M43I/A71G/D90G | 2272 | 208017 | 1.32 | 9249 | 0.51 | 56172 | 4.73 | 6 |
| E35D/T41S/M43I/M47V/A71G | 2273 | 243502 | 1.55 | 2845 | 0.16 | 44419 | 3.74 | 16 |
| E35D/T41S/M43I/M47L/A71G | 2274 | 209034 | 1.33 | 3104 | 0.17 | 59613 | 5.02 | 19 |
| H18Y/V22A/E35D/M47V/T62S/A71G | 2275 | 219782 | 1.40 | 4214 | 0.23 | 87702 | 7.39 | 21 |
| H18Y/A26E/E35D/M47L/V68M/A71G/D90G | 2276 | 253787 | 1.61 | 14934 | 0.83 | 170935 | 14.40 | 11 |
| E35D/K37E/M47V/N48D/L85Q/D90N | 2277 | 243506 | 1.55 | 1589 | 0.09 | 26542 | 2.24 | 17 |
| Q27H/E35D/D46V/M47L/A71G | 2278 | 157358 | 1.00 | 10412 | 0.58 | 60139 | 5.07 | 6 |
| V22L/Q27H/E35D/M47I/A71G | 2279 | 151600 | 0.96 | 7269 | 0.40 | 43797 | 3.69 | 6 |
| E35D/D46V/M47L/V68M/L85Q/E88D | 2280 | 224734 | 1.43 | 5027 | 0.28 | 137368 | 11.57 | 27 |
| E35D/T41S/M43V/M47I/L70M/A71G | 2281 | 249456 | 1.59 | 2698 | 0.15 | 12978 | 1.09 | 5 |
| E35D/D46E/M47V/N63D/L85Q | 2282 | 274320 | 1.74 | 1331 | 0.07 | 69780 | 5.88 | 52 |
| E35D/M47V/T62A/A71D/K93E | 2283 | 225737 | 1.44 | 12030 | 0.67 | 693 | 0.06 | 0 |
| E35D/D46E/M47V/V68M/D90G/K93E | 2284 | 273157 | 1.74 | 27080 | 1.50 | 71903 | 6.06 | 3 |
| E35D/M43I/M47V/K89N | 2285 | 278391 | 1.77 | 6752 | 0.37 | 19250 | 1.62 | 3 |
| E35D/M47L/A71G/L85M/F92Y | 2286 | 215998 | 1.37 | 2459 | 0.14 | 46684 | 3.93 | 19 |
| E35D/M42V/M47V/E52D/L85Q | 2287 | 225986 | 1.44 | 1291 | 0.07 | 11897 | 1.00 | 9 |
| V22D/E35D/M47L/L70M/L97Q | 2288 | 127835 | 0.81 | 527 | 0.03 | 17670 | 1.49 | 34 |
| E35D/T41S/M47V/L97Q | 2289 | 262204 | 1.67 | 290 | 0.02 | 13591 | 1.14 | 47 |

TABLE 13-continued

Variant CD80 Flow Binding to Jurkat Cells (CD28) and CHO cells stably expressing CTLA4 or PD-L1

| CD80 mutation(s) | SEQ ID NO (IgV) | CTLA4 MFI at 33.3 nM | CTLA4 Fold change to WT CD80 | CD28 MFI at 33.3 nM | CD28 Fold change to WT CD80 | PD-L1 MFI at 33.3 nM | PD-L1 Fold change to WT CD80 | Ratio of PDL1: CD28 |
|---|---|---|---|---|---|---|---|---|
| E35D/Y53H/A71G/D90G/L97R | 2290 | 182701 | 1.16 | 1547 | 0.09 | 57455 | 4.84 | 37 |
| E35D/A71D/L72V/R73H/E81K | 2291 | 186582 | 1.19 | 3365 | 0.19 | 503 | 0.04 | 0 |
| Q33L/E35D/M43I/Y53F/T62S/L85Q | 2292 | 3985 | 0.03 | 1024 | 0.06 | 72065 | 6.07 | 70 |
| E35D/M38T/D46E/M47V/N48S | 2293 | 175387 | 1.11 | 587 | 0.03 | 19393 | 1.63 | 33 |
| Q33R/E35D/M47V/N48K/L85M/F92L | 2294 | 2680 | 0.02 | 265 | 0.01 | 21425 | 1.80 | 81 |
| E35D/M38T/M43V/M47V/N48R/L85Q | 2295 | 203938 | 1.30 | 285 | 0.02 | 21795 | 1.84 | 76 |
| T28Y/Q33H/E35D/D46V/M47I/A71G | 2296 | 156810 | 1.00 | 298 | 0.02 | 46038 | 3.88 | 154 |
| WT CD80 ECD-Fc (R & D) | 2 | 157306 | 1.00 | 18035 | 1.00 | 11871 | 1.00 | 1 |

Figure 9A:
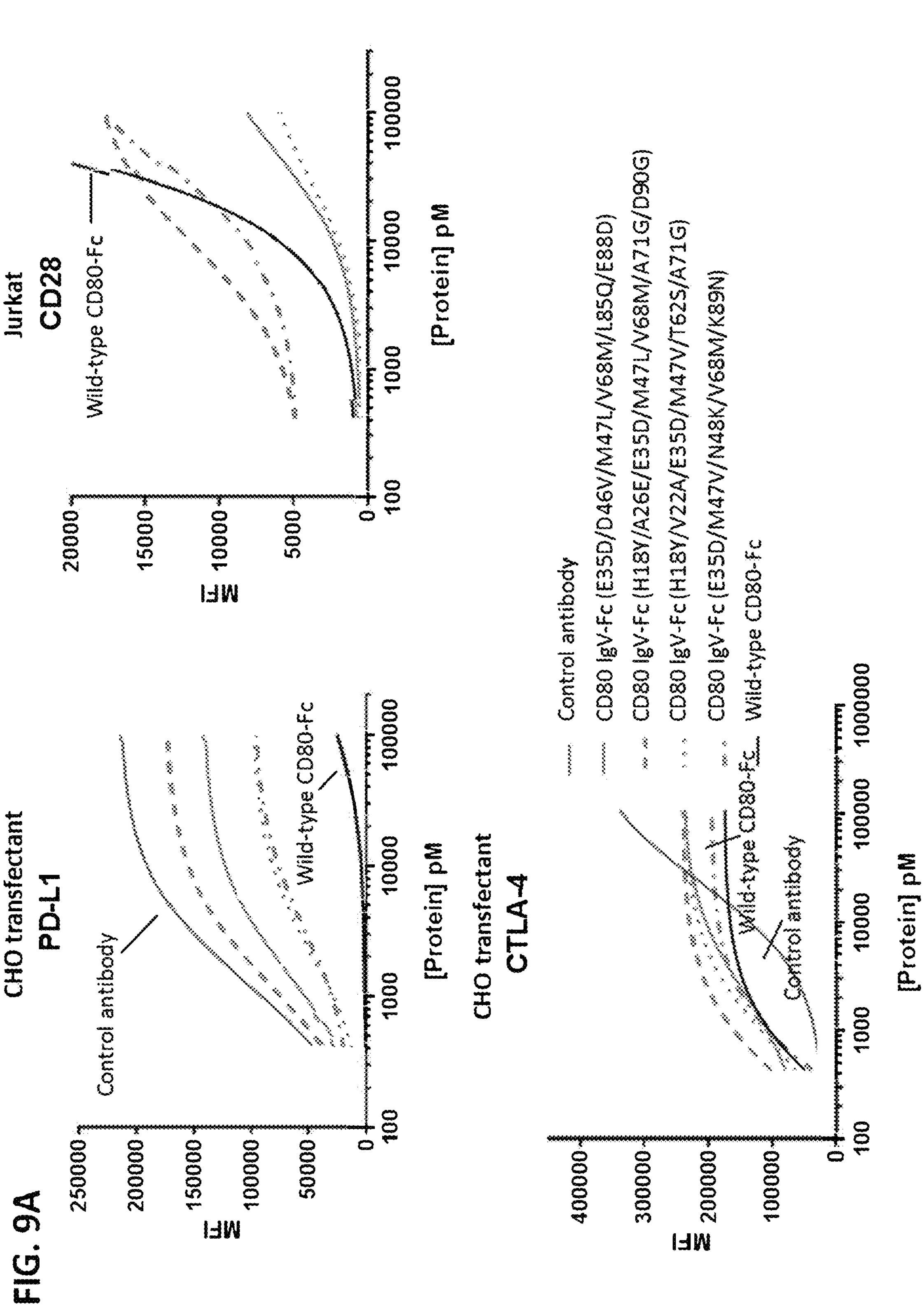
FIG. 9A depicts binding of exemplary CD80 IgV-Fc variants to cell surface-expressed PD-L1, CD28 and CTL44 ligands.

To further compare binding, various concentrations of exemplary variant CD80 IgV-Fc molecules were assessed and compared to wild-type CD80 IgV-Fc for binding to cell surface expressed PD-L1, CD28 and CTLA-4. The exemplary tested variant CD80 IgV-Fc included: E35D/D46V/M47L/V68M/L85Q/E88D (SEQ ID NO: 2280), H18Y/A26E/E35D/M47L/V68M/A71G/D90G (SEQ ID NO: 2276), H18Y/V22A/E35D/M47V/T62S/A71G (SEQ ID NO: 2275), and E35D/M47V/N48K/V68M/K89N (SEQ ID NO:2250). Binding to CD28 was assessed using Jurkat/L2 reporter cells expressing CD28 and binding to CTLA-4 and PD-L1 was assessed using CHO cells stably transfected to express huCTLA-4 or huPD-L1 as described above. Indicated transfectants or cell lines were plated and stained with titrated amounts of CD80 vIgD-Fc or wild-type CD80 IgV-Fc. Bound protein was detected with fluorochrome conjugated anti-huFc and Mean Fluorescence Intensity (MFI) measured by flow cytometry. As shown in FIG. 9A, some tested CD80 vIgD-Fc bound human PD-L1, human CTLA-4, and human CD28 with higher affinity than wild-type CD80.

Example 8

Assessment of Bioactivity of Affinity-Matured CD80 IgSF Domain-Containing Molecules Using a Jurkat/IL2 Reporter Assay This Example describes a Jurkat/IL2 reporter assay to assess bioactivity of CD80 domain variant immunomodulatory proteins for blockade of CD28 costimulation.

The day before the assay, the assay plate was prepared. To prepare the assay plate, 10 nM anti-CD3 antibody (clone OKT3; BioLegend, catalog no. 317315) and 20 nM CD86-Fc (R&D Systems, catalog no. 141-B2) in PBS were aliquoted at 100 μL/well into a white, flat-bottom 96-well plate (Costar). The plate was incubated overnight at 4° C. to allow the antibody and CD86-Fc protein to adhere to the surface of the plate. The next day, the wells of the assay plate were washed twice with 150 μL PBS prior to the assay.

The day of the assay, 60 μL exemplary variant CD80 IgV-Fc fusion molecules and control, wildtype CD80 IgV-Fc or wildtype CD80 (ECD)-Fc, molecules, or negative control Fc alone, were diluted to a concentration of 40 nM in assay buffer (RPMI1640+5% fetal bovine serum (FBS)), or buffer alone, and were added to the wells of a fresh 96-well polypropylene plate. Jurkat effector cells expressing IL-2-luciferase reporter were counted and resuspended in assay buffer to a concentration of $2\times10^6$ cells/mL. 60 μL of the Jurkat cell suspension were then added to the wells containing the CD80-Fc fusion molecules or controls. The cells and CD80 proteins were incubated at room temperature for 15 minutes and then 100 μL of the cell/CD80 protein mixture were transferred/well of the prepared anti-CD3/CD86-Fc assay plate.

The assay plate was briefly spun down (10 seconds at 1200 RPM) and incubated at 37° C. for 5 hours. After the 5 hour incubation, the plate was removed and equilibrated to room temperature for 15 minutes. 100 μL of Bio-Glo (Promega) were added/well of the assay plate, which was then placed on an orbital shaker for 10 minutes. Luminescence was measured with a 1 second per well integration time using a BioTek Cytation 3 luminometer.

An average relative luminescence value was determined for each variant CD80 IgV Fc and a fold increase in IL-2 reporter signal was calculated for each variant compared to wildtype CD80 IgV-Fc protein. The results are provided in Table 14 below.

As shown in Table 14, co-culturing most of the exemplary variant CD80 IgV-Fc molecules with Jurkat effector cells expressing IL-2-luciferase reporter, resulted in decreased CD28 costimulation (i. e., blockade) compared to buffer only or the Fe-only negative control. In contrast, several of the variant CD80 IgV-Fc molecules appeared to increase the CD28 costimulatory signal compared to the wild-type CD80 IgV-Fc molecule suggesting possible agonistic activity.

TABLE 14

Jurkat/IL2 Reporter Assay: Blockade of CD28 Costimulation

| CD80 Mutation(s) | SEQ ID NO (IgV) | Average Relative Luminescence Units | Fold increase in IL2 reporter signal |
|---|---|---|---|
| Q27H/T41S/A71D | 153 | 1301 | 0.32 |
| I30T/L70R | 154 | 3236 | 0.79 |

TABLE 14-continued

| Jurkat/IL2 Reporter Assay: Blockade of CD28 Costimulation | | | |
|---|---|---|---|
| CD80 Mutation(s) | SEQ ID NO (IgV) | Average Relative Luminescence Units | Fold increase in IL2 reporter signal |
| T13R/C16R/L70Q/A71D | 155 | 3204 | 0.78 |
| T57I | 156 | 1463 | 0.36 |
| M43I/C82R | 157 | 1326 | 0.32 |
| V22L/M38V/M47T/A71D/L85M | 158 | 1770 | 0.43 |
| I30V/T57I/L70P/A71D/A91T | 159 | 1731 | 0.42 |
| V22I/L70M/A71D | 160 | 253 | 0.06 |
| N55D/K86M | 163 | 4277 | 1.04 |
| L72P/T79I | 164 | 4157 | 1.01 |
| L70P/F92S | 165 | 5035 | 1.22 |
| T79P | 166 | 4397 | 1.07 |
| E35D/M47I/L65P/D90N | 167 | 2377 | 0.58 |
| L25S/E35D/M47I/D90N | 168 | 2567 | 0.62 |
| A71D | 170 | 999 | 0.24 |
| E81K/A91S | 172 | 4038 | 0.98 |
| A12V/M47V/L70M | 173 | 4999 | 1.22 |
| K34E/T41A/L72V | 174 | 4225 | 1.03 |
| T41S/A71D/V84A | 175 | 2685 | 0.65 |
| E35D/A71D | 176 | 1461 | 0.36 |
| E35D/M47I | 177 | 1444 | 0.35 |
| K36R/G78A | 178 | 2597 | 0.63 |
| Q33E/T41A | 179 | 4220 | 1.03 |
| M47V/N48H | 180 | 2656 | 0.65 |
| M47L/V68A | 181 | 5445 | 1.32 |
| S44P/A71D | 182 | 2848 | 0.69 |
| Q27H/M43I/A71D/R73S | 183 | 1891 | 0.46 |
| E35D/T57I/L70Q/A71D | 185 | 280 | 0.07 |
| M47I/E88D | 186 | 2178 | 0.53 |
| M42I/I61V/A71D | 187 | 2549 | 0.62 |
| P51A/A71D | 188 | 4690 | 1.14 |
| H18Y/M47I/T57I/A71G | 189 | 924 | 0.22 |
| V20I/M47V/T57I/V84I | 190 | 1870 | 0.45 |
| V20I/M47V/A71D | 191 | 360 | 0.09 |
| A71D/L72V/E95K | 192 | 2939 | 0.71 |
| V22L/E35G/A71D/L72P | 193 | 2334 | 0.57 |
| E35D/A71D | 194 | 812 | 0.20 |
| E35D/I67L/A71D | 195 | 1223 | 0.30 |
| T13R/M42V/M47I/A71D | 197 | 759 | 0.18 |
| E35D | 198 | 1981 | 0.48 |
| E35D/M47I/L70M | 199 | 1077 | 0.26 |
| E35D/A7I/L72V | 200 | 1152 | 0.28 |
| E35D/M43L/L70M | 201 | 3640 | 0.88 |
| A26P/E35D/N443I/L85Q/E88D | 202 | 4078 | 0.99 |
| E35D/D46V/L85Q | 203 | 3230 | 0.79 |
| Q27L/E35D/M47I/T57I/L70Q/E88D | 204 | 1180 | 0.29 |
| Q27H/E35G/A71D/L72P/T79I | 196 | 2000 | 0.49 |
| M47V/I69F/A71D/V83I | 205 | 290 | 0.07 |
| E35D/T57A/A71D/L85Q | 206 | 3213 | 0.78 |
| H18Y/A26T/E35D/A71D/L85Q | 207 | 2773 | 0.67 |
| E35D/M47L | 208 | 1110 | 0.27 |
| E23D/M42V/M43I/I58V/L70R | 209 | 4460 | 1.08 |
| V68M/L70M/A71D/E95K | 210 | 2067 | 0.50 |
| N55I/T57I/I69F | 211 | 1915 | 0.47 |
| E35D/M43I/A71D | 212 | 3019 | 0.73 |
| T41S/T57I/L70R | 213 | 3641 | 0.89 |
| H18Y/A71D/L72P/E88V | 214 | 1354 | 0.33 |
| V20I/A71D | 215 | 2165 | 0.53 |
| E23G/A26S/E35D/T62N/A71D/L72V/L85M | 216 | 2067 | 0.50 |
| A12T/E24D/E35D/D46V/I61V/L72P/E95V | 217 | 2408 | 0.59 |
| V22L/E35D/M43L/A71G/D76H | 218 | 2004 | 0.49 |
| E35G/K54E/A71D/L72P | 219 | 3618 | 0.88 |
| L70Q/A71D | 220 | 1036 | 0.25 |
| A26E/E35D/M47L/L85Q | 221 | 4111 | 1.00 |
| D46E/A71D | 222 | 490 | 0.12 |
| Y31H/E35D/T41S/V68L/K93R/R94W | 223 | 3678 | 0.89 |
| WT CD80 IgV-Fc | 3031 | 4113 | 1.00 |
| WT CD80 ECD-Fc | 2 | 3816 | 0.93 |
| Fc only Control | — | 4107 | 1.00 |
| Buffer Only | — | 4173.25 | 1.01 |

Example 9

Assessment of Bioactivity of Affinity-Matured CD80 IgSF Domain-Containing Molecules in the Presence and Absence of PD-L1 Using a Jurkat/IL2 Reporter Assay This Example describes a Jurkat/IL2 reporter assay to assess the capacity of CD80 domain variant immunomodulatory proteins fused to either an inert Fc molecule (e.g. SEQ ID NO:1714) or an Fc molecule capable of mediating effector activity (SEQ ID NO:1429) to modulate CD28 costimulation signal in the presence or absence of PD-L1-expressing antigen presenting cells.

A. PD-L1-dependent CD28 costimulation

Jurkat effector cells expressing an IL-2-luciferase reporter (purchased from Promega Corp., USA) were suspended at $2\times10^6$ cells/mL in Jurkat Assay buffer (RPMI1640+5% FBS). Jurkat cells were then plated at 50 μL/well for a total of 100,000 cells per well.

To each well, 25 μL of test protein was added to the Jurkat cells. Test proteins included variant CD80 IgV-Fc (inert) fusion molecules or full CD80-ECD-Fc (R&D Systems, USA) or wild type CD80-IgV-Fc (inert). All proteins were added at: 200 nM, 66.7 nM, and 22.2 nM (no PD-L1) or 200 nM, 66.7 nM, 22.2 nM, 7.4 nM, and 2.5 nM (+PD-L1). The Jurkat cells with test or control proteins were incubated for 15 minutes at room temperature. CHO-derived artificial antigen presenting cells (aAPC) displaying transduced cell surface anti-CD3 single chain Fv (OKT3) (i.e., no PD-L1), or OKT3 and PD-L1(i.e., +PD-L1), were brought to $0.8\times10^6$ cells/mL, and 25 μL of cells were added to each well, bringing the final volume of each well to 100 μL. Each well had a final ratio of 5:1 Jurkat:CHO cells and a test protein concentration of 50, 16.7 or 5.6 nM (no PD-L1), or 50, 16.7, 5.6, 1.9, and 0.6 nM (+PD-L1). Jurkat cells and CHO cells were incubated for 5 hours at 37 degrees Celsius in a humidified 5% C02 incubation chamber. Plates were then removed from the incubator and acclimated to room temperature for 15 minutes. 100 μL of a cell lysis and luciferase substrate solution (BioGlo luciferase reagent, Promega) were added to each well and the plates were incubated on an orbital shaker for 10 minutes. Luminescence was measured with a 1 second per well integration time using a BioTek Cytation luminometer, and a relative luminescence value (RLU) was determined for each test sample. The results are provided in Table 15.

In the absence of PD-L1 on the aAPC, little to no co-stimulatory signal was observed consistent with the observation that variant CD80 molecules fused to an inert Fc were not able to induce a costimulatory signal via CD28. In the presence of PD-L1, however, several of the variant CD80-IgV-Fc (inert) molecules tested exhibited concentration dependent CD28 costimulation that was correlated with the CD28 and/or PD-L1 binding affinity of the variant molecules. This result indicates that variant CD80 molecules with increased affinity to PD-L1 are able to mediate PD-L1-dependent costimulation of CD28.

TABLE 15

PD-L1-Dependent CD28 Costimulation

| CD80 Mutation(s) | SEQ ID NO (IgV) | No PD-L1 5.6 nM | 16.7 nM | 50 nM | +PD-L1 0.6 nM | 1.9 nM | 5.6 nM | 16.7 nM | 50 nM |
|---|---|---|---|---|---|---|---|---|---|
| E35D/M47I | 177 | 637 | 710 | 894 | 1047 | 1732 | 2794 | 3672 | 3778 |
| A71D/L72V/E95K | 192 | 466 | 547 | 644 | 524 | 530 | 617 | 641 | 755 |
| E35D | 198 | 412 | 480 | 448 | 456 | 465 | 625 | 995 | 1606 |
| E35D/M47I/L70M | 199 | 549 | 544 | 600 | 1004 | 1640 | 2348 | 2629 | 2629 |
| E35D/M43L/L70M | 201 | 396 | 439 | 515 | 479 | 525 | 683 | 1066 | 1809 |
| E35D/D46V/L85Q | 203 | 511 | 554 | 720 | 611 | 1001 | 1486 | 1814 | 2224 |
| H18Y/A26T/E35D/A71D/L85Q | 207 | 638 | 660 | 926 | 628 | 621 | 795 | 974 | 1156 |
| E35D/M47L | 208 | 633 | 731 | 817 | 1041 | 1730 | 2580 | 3069 | 2906 |
| E23G/A26S/E35D/T62N/A71D/L72V/L85M | 216 | 566 | 560 | 606 | 524 | 604 | 659 | 689 | 695 |
| E35G/K54E/A71D/L72P | 219 | 417 | 475 | 440 | 529 | 489 | 554 | 504 | 476 |
| A26E/E35D/M47L/L85Q | 221 | 458 | 415 | 432 | 509 | 618 | 886 | 1385 | 1998 |
| WT CD80 IgV-Fc (inert) | 3031 | 450 | 444 | 479 | 458 | 486 | 511 | 523 | 483 |
| WT CD80 ECD-Fc (inert) | 2 | 436 | 412 | 420 | 518 | 474 | 505 | 462 | 449 |
| Fc only Control | — | 419 | 406 | 395 | 501 | 457 | 438 | 451 | 440 |

In a further experiment, other variant CD80 IgV-Fc (inert) fusion proteins were tested for CD28 stimulation in the absence of aAPCs+/−PD-L1 as described above, except the final concentrations of each test protein were 50 nM and 5 nM. A relative luminescence value (RLU) was determined for each test sample and a fold increase (or decrease) in IL-2 reporter signal was calculated for each variant CD80-IgV molecule and compared to wildtype CD80-ECD-Fc (inert) and CD80-IgV-Fc (inert) proteins.

As shown in Tables 16 and 17, the luciferase activity of the Jurkat effector cells co-cultured with K562/OKT3/PD-L aAPC and 50 nM CD8-IgV-Fc(inert) molecules was altered (increased or decreased) for several of the molecules tested. Simultaneous binding of PD-L1 on the aAPC and CD28 on the Jurkat cell resulted in increased CD28-costimulation and downstream IL-2 signal transduction. Fold increase (or decrease) in luminescence relative to wildtype CD8-IgV-Fc (inert) is also shown. In the Table, the first column sets forth the mutation(s), and the second column sets forth the SEQ ID NO identifier for each CD80-IgV of a CD80-IgV Fc (inert) variant tested.

TABLE 16

| Jurkat/IL2 + K562/OKT3/PD-L1 Reporter Assay: Relative Luciferase Units (RLU) | | | |
|---|---|---|---|
| CD80 Mutation(s) | SEQ ID NO (IgV) | CD80-FC Conc. 50 nM | Fold Increase over WT CD80-IgV-Fc |
| A26E/Q33R/E35D/M47L/L85Q/K86E | 2201 | 569 | 1.0 |
| A26E/Q33R/E35D/M47L/L85Q | 2202 | 500 | 0.9 |
| E35D/M47L/L85Q | 2203 | 2852 | 5.0 |
| A26E/Q33L/E35D/M47L/L85Q | 2204 | 416 | 0.7 |
| A26E/Q33L/E35D/M47L | 2205 | 476 | 0.8 |
| H18Y/A26E/Q33L/E35D/M47L/L85Q | 2206 | 408 | 0.7 |
| Q33L/E35D/M47I | 2207 | 423 | 0.7 |
| H18Y/Q33L/E35D/M47I | 2208 | 486 | 0.9 |
| Q33L/E35D/D46E/M47I | 2209 | 554 | 1.0 |
| Q33R/E35D/D46E/M47I | 2210 | 522 | 0.9 |
| H18Y/E35D/M47L | 2211 | 2976 | 5.3 |
| Q33L/E35D/M47V | 2212 | 393 | 0.7 |
| Q33L/E35D/M47V/T79A | 2213 | 527 | 0.9 |
| Q33L/E35D/T41S/M47V | 2214 | 481 | 0.8 |
| Q33L/E35D/M47I/L85Q | 2215 | 432 | 0.8 |
| Q33L/E35D/M47I/T62N/L85Q | 2216 | 463 | 0.8 |
| Q33L/E35D/M47V/L85Q | 2217 | 556 | 1.0 |
| A26E/E35D/M43T/M47L/L85Q/R94Q | 2218 | 526 | 0.9 |
| Q33R/E35D/K37E/M47V/L85Q | 2219 | 464 | 0.8 |
| V22A/E23D/Q33L/E35D/M47V | 2220 | 390 | 0.7 |
| E24D/Q33L/E35D/M47V/K54R/L85Q | 2221 | 3235 | 5.7 |
| S15P/Q33L/E35D/M47L/L85Q | 2222 | 468 | 0.8 |
| E7D/E35D/M47I/L97Q | 2223 | 1243 | 2.2 |
| Q33L/E35D/T41S/M43I | 2224 | 533 | 0.9 |
| E35D/M47I/K54R/L85E | 2225 | 602 | 1.1 |
| Q33K/E35D/D46V/L85Q | 2226 | 504 | 0.9 |
| Y31S/E35D/M47L/T79L/E88G | 2227 | 496 | 0.9 |
| H18L/V22A/E35D/M47L/N48T/L85Q | 2228 | 2652 | 4.7 |
| Q27H/E35D/M47L/L85Q/R94Q/E95K | 2229 | 513 | 0.9 |
| Q33K/E35D/M47V/K89E/K93R | 2230 | 415 | 0.7 |
| E35D/M47I/E77A/L85Q/R94W | 2231 | 473 | 0.8 |
| A26E/E35D/M43I/M47L/L85Q/K86E/R94W | 2232 | 498 | 0.9 |
| Q27H/Q33L/E35D/M47V/N55D/L85Q/K89N | 2233 | 551 | 1.0 |
| H18Y/V20A/Q33L/E35D/M47V/Y53F | 2234 | 566 | 1.0 |
| V22A/E35D/V68E/A71D | 2235 | 538 | 1.0 |
| Q33L/E35D/M47L/A71G/F92S | 2236 | 394 | 0.7 |
| V22A/R29H/E35D/D46E/M47I | 2237 | 3314 | 5.9 |
| Q33L/E35D/M43I/L85Q/R94W | 2238 | 553 | 1.0 |
| H18Y/E35D/V68M/L97Q | 2239 | 4336 | 7.7 |
| Q33L/E35D/M47L/V68M/L85Q/E88D | 2240 | 572 | 1.0 |
| Q33L/E35D/M43V/M47I/A71G | 2241 | 473 | 0.8 |
| E35D/M47L/A71G/L97Q | 2242 | 2156 | 3.8 |
| E35D/M47V/A71G/L85M/L97Q | 2243 | 576 | 1.0 |
| H18Y/Y31H/E35D/M47V/A71G/L85Q | 2244 | 455 | 0.8 |
| E35D/D46E/M47V/L97Q | 2245 | 1087 | 1.9 |
| E35D/D46V/M47I/A71G/F92V | 2246 | 2254 | 4.0 |
| E35D/M47V/T62A/A71G/V83A/Y87H/L97M | 2247 | 438 | 0.8 |
| Q33L/E35D/N48K/L85Q/L97Q | 2248 | 358 | 0.6 |
| WT CD80-ECD-Fc (effector) | 2 | 3045 | 5.4 |
| WT CD80 IgV-Fc (inert) | 3031 | 566 | 1 |

TABLE 17

| Jurkat/IL2 + K562/OKT3/PD-L1 Reporter Assay: Relative Luciferase Units (RLU) | | | |
|---|---|---|---|
| CD80 Mutation(s) | SEQ ID NO (IgV) | CD80-FC Conc 50 nM | Fold Increase over WT CD80-IgV-Fc |
| E35D/L85Q/K93T/E95V/L97Q | 2249 | 315 | 1.5 |
| E35D/M47V/N48K/V68M/K89N | 2250 | 1439 | 7.0 |
| Q33L/E35D/M47I/N48D/A71G | 2251 | 213 | 1.0 |
| R29H/E35D/M43V/M47I/I49V | 2252 | 227 | 1.1 |
| Q27H/E35D/M47I/L85Q/D90G | 2253 | 1313 | 6.4 |
| E35D/M47I/L85Q/D90G | 2254 | 1438 | 7.0 |
| E35D/M47I/T62S/L85Q | 2255 | 1571 | 7.6 |
| A26E/E35D/M47L/A71G | 2256 | 1748 | 8.5 |

TABLE 17-continued

Jurkat/IL2 + K562/OKT3/PD-L1 Reporter Assay: Relative Luciferase Units (RLU)

| CD80 Mutation(s) | SEQ ID NO (IgV) | CD80-FC Conc 50 nM | Fold Increase over WT CD80-IgV-Fc |
|---|---|---|---|
| E35D/M47I/Y87Q/K89E | 2257 | 1581 | 7.7 |
| V22A/E35D/M47I/Y87N | 2258 | 1388 | 6.7 |
| H18Y/A26E/E35D/M47L/L85Q/D90G | 2259 | 1506 | 7.3 |
| E35D/M47L/A71G/L85Q | 2260 | 1256 | 6.1 |
| E35D/M47V/A71G/E88D | 2261 | 1216 | 5.9 |
| E35D/A71G | 2262 | 1190 | 5.8 |
| E35D/M47V/A71G | 2263 | 1190 | 5.8 |
| I30V/E35D/M47V/A71G/A91V | 2264 | 1503 | 7.3 |
| V22D/E35D/M47L/L85Q | 2266 | 1142 | 5.5 |
| H18Y/E35D/N48K | 2267 | 1230 | 6.0 |
| E35D/T41S/M47V/A71G/K89N | 2268 | 1023 | 5.0 |
| E35D/M47V/N48T/L85Q | 2269 | 897 | 4.4 |
| E35D/D46E/M47V/A71D/D90G | 2270 | 1042 | 5.1 |
| E35D/D46E/M47V/A71D | 2271 | 683 | 3.3 |
| E35D/T41S/M43I/A71G/D90G | 2272 | 1122 | 5.4 |
| E35D/T41S/M43I/M47V/A71G | 2273 | 1273 | 6.2 |
| E35D/T41S/M43I/M47L/A71G | 2274 | 1535 | 7.5 |
| H18Y/V22A/E35D/M47V/T62S/A71G | 2275 | 1379 | 6.7 |
| H18Y/A26E/E35D/M47L/V68M/A71G/D90G | 2276 | 1116 | 5.4 |
| E35D/K37E/M47V/N48D/L85Q/D90N | 2277 | 851 | 4.1 |
| Q27H/E35D/D46V/M47L/A71G | 2278 | 978 | 4.7 |
| V22L/Q27H/E35D/M47I/A71G | 2279 | 1123 | 5.5 |
| E35D/D46V/M47L/V68M/L85Q/E88D | 2280 | 1464 | 7.1 |
| E35D/T41S/M43V/M47I/L70M/A71G | 2281 | 1672 | 8.1 |
| E35D/D46E/M47V/N63D/L85Q | 2282 | 1381 | 6.7 |
| E35D/M47V/T62A/A71D/K93E | 2283 | 1056 | 5.1 |
| E35D/D46E/M47V/V68M/D90G/K93E | 2284 | 1261 | 6.1 |
| E35D/M43I/M47V/K89N | 2285 | 1094 | 5.3 |
| E35D/M47L/A71G/L85M/F92Y | 2286 | 1322 | 6.4 |
| E35D/M42V/M47V/E52D/L85Q | 2287 | 1260 | 6.1 |
| V22D/E35D/M47L/L70M/L97Q | 2288 | 1542 | 7.5 |
| E35D/T41S/M47V/L97Q | 2289 | 594 | 2.9 |
| E35D/Y53H/A71G/D90G/L97R | 2290 | 1723 | 8.4 |
| E35D/A71D/L72V/R73H/E81K | 2291 | 282 | 1.4 |
| Q33L/E35D/M43I/Y53F/T62S/L85Q | 2292 | 168 | 0.8 |
| E35D/M38T/D46E/M47V/N48S | 2293 | 1315 | 6.4 |
| Q33R/E35D/M47V/N48K/L85M/F92L | 2294 | 215 | 1.0 |
| E35D/M38T/M43V/M47V/N48R/L85Q | 2295 | 680 | 3.3 |
| T28Y/Q33H/E35D/D46V/M47I/A71G | 2296 | 580 | 2.8 |
| WT CD80 ECD-Fc (effector) | 2 | 1786 | 8.7 |
| WT CD80-IgV-Fc (inert) | 3031 | 206 | 1.0 |

Figure 9B:
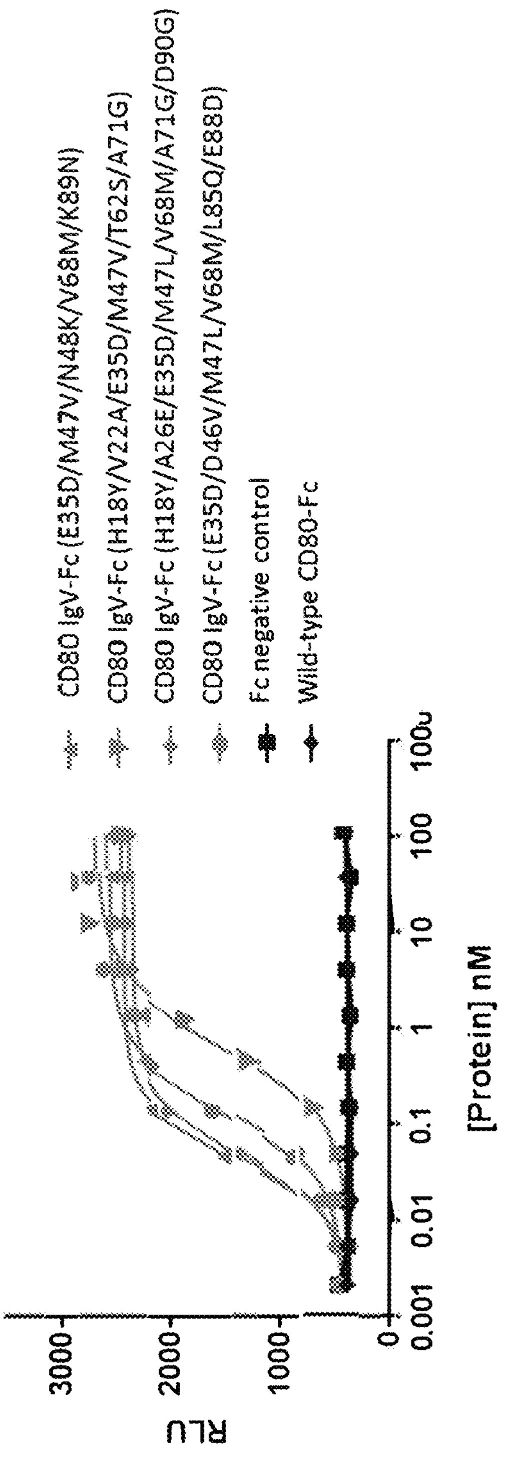
FIG. 9B depicts dose-dependent PD-L1-dependent CD28 costimulation in a Jurkat/IL-2 reporter line induced by exemplary CD80 IgV-Fc variants.

To further compare activity, various concentrations of exemplary variant CD80 IgV-Fc (inert) were assessed for induction of luciferase activity in Jurkat/IL2 reporter cells using the K562/OKT3/PDL1 aAPC cell line described above and activity was compared to wildtype CD80 IgV-Fc (inert). The exemplary variant CD80 IgV molecules that were tested contained E35D/M47V/N48K/V68M/K89N (SEQ ID NO: 2250), H18Y/V22A/E35D/M47V/T62S/A71G (SEQ ID NO: 2275), H18Y/A26E/E35D/M47L/V68M/A71G/D90G (SEQ ID NO: 2276), and E35D/D46V/M47L/V68M/L85Q/E88D (SEQ ID NO: 2280). As shown in FIG. 9B, the exemplary tested variant CD80 IgV domain-containing molecules induced PD-L1 dependent CD28 costimulation in a dose-dependent manner. No PD-L1 dependent CD28 costimulation was observed by wildtype CD80 IgV-Fc at any of the assessed concentrations.

B. Cytokine production following PD-L1-Dependent Costimulation

Figure 9C:
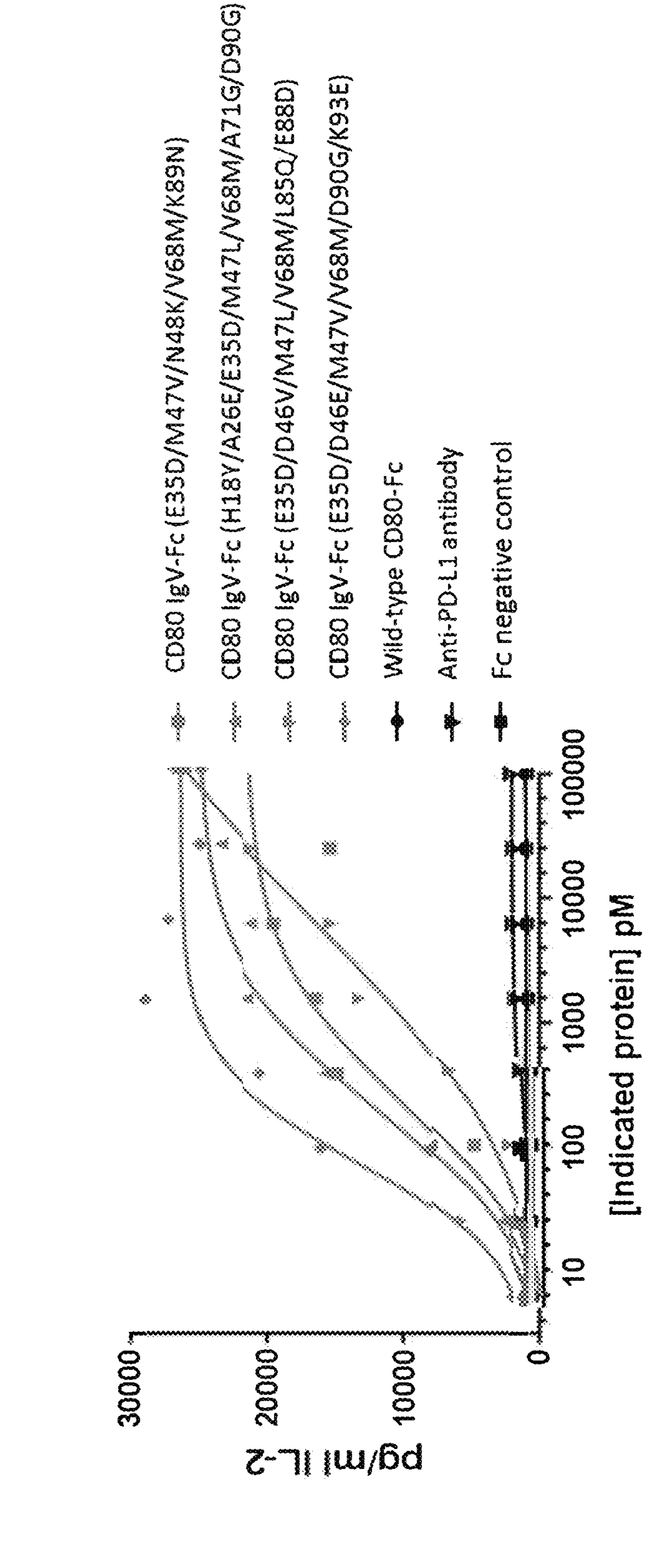
FIG. 9C depicts human primary T cell cytokine production following PD-L1-dependent costimulation induced by exemplary CD80 IgV-Fc variants.

K562/OKT3/PDL1 aAPC cells described above were treated with mitomycin-c and co-cultured with primary human pan T cells in the presence of titrated increasing concentrations of CD80 IgV-Fc (inert) or wildtype CD80 IgV-Fc (inert). Exemplary variant CD80-Fcs tested contained E35D/M47V/N48K/V68M/K89N (SEQ ID NO: 2250), H18Y/A26E/E35D/M47L/V68M/A71G/D90G (SEQ ID NO: 2276), E35D/D46V/M47L/V68M/L85Q/E88D (SEQ ID NO: 2280), E35D/D46E/M47V/V68M/D90G/K93E (SEQ ID NO: 2284). As a further control, primary human pan T cells also were cultured with the exemplary anti-PD-L1 durvalumab or an Fe (inert) only control. Results, set forth in FIG. 9C, showed that the tested variant CD80-IgV-Fc molecules resulted in IL-2 secretion in culture supernatants, consistent with an observation that PD-L1 dependent co-stimulation was induced by the tested exemplary variant CD80-IgV-Fc molecules. IL-2 production was not observed in T cell cultures when incubated with wildtype CD80-IgV Fc or other tested controls.

C. Fc-Dependent CD28 Costimulation+/−PD-L1

In a further experiment, CD28 costimulation was assessed for variant CD80-IgV-Fc fusion proteins, where the Fc was an IgG1 Fc (e.g. SEQ ID NO:1429) capable of mediating effector activity via binding to Fc receptors (FcR). The experiment was carried out as described in part A above, except CD32-expressing K562 cells stably transduced with OKT3 (K562/OKT3) or OKT3 and PD-L1 (K562/OKT3/PD-L1) were used instead of the CHO/OKT3 and CHO/OKT3/PD-L1 cells, and the results are depicted in Table 18.

TABLE 18

CD28 Cosbmulation via Fc Receptor or PD-L1 Dependent Cross-Linking

| CD80 Mutation(s) | SEQ ID NO (IgV) | K562/OKT3 aAPC FcR Dependent Cross-Linking (No PD-L1) | | | | | K562/OKT3/PD-L1 aAPC Combination of FcR and/or PD-L1 Dependent Cross-Linking | | | | |
|---|---|---|---|---|---|---|---|---|---|---|---|
| | | 0.6 nM | 1.9 nM | 5.6 nM | 16.7 nM | 50 nM | 0.6 nM | 1.9 nM | 5.6 nM | 16.7 nM | 50 nM |
| E35D/M47I | 177 | 1777 | 2133 | 3651 | 5792 | 7144 | 2832 | 3604 | 4702 | 5321 | 5704 |
| A71D/L72V/E95K | 192 | 1821 | 2588 | 4127 | 5553 | 7109 | 1060 | 1537 | 2517 | 3642 | 4031 |
| E35D | 198 | 1402 | 1328 | 1300 | 1318 | 1203 | 920 | 1113 | 1397 | 1765 | 2270 |
| E35D/M47I/L70M | 199 | 1609 | 2520 | 4231 | 5370 | 5780 | 2238 | 2689 | 3654 | 3907 | 3870 |
| E35D/M43L/L70M | 201 | 1349 | 1336 | 1404 | 1345 | 1573 | 1022 | 1250 | 1616 | 2046 | 2780 |
| E35D/D46V/L85Q | 203 | 1880 | 2721 | 4396 | 6023 | 7015 | 1418 | 2432 | 3306 | 3645 | 4126 |
| H18Y/A26T/E35D/A71D/L85Q | 207 | 2081 | 2808 | 4550 | 6958 | 8747 | 1156 | 1825 | 3121 | 4329 | 5215 |
| E35D/M47L | 208 | 2119 | 3042 | 5615 | 7736 | 8685 | 2783 | 3846 | 4726 | 5406 | 5036 |
| E23G/A26S/E35D/T62N/ A71D/L72V/L85M | 216 | 2022 | 3300 | 5052 | 7011 | 7855 | 1153 | 1949 | 3219 | 4042 | 4138 |
| E35G/K54E/A71D/L72P | 219 | 1337 | 1367 | 1380 | 1430 | 1510 | 689 | 732 | 735 | 701 | 805 |
| A26E/E35D/M47L/L85Q | 221 | 1350 | 1382 | 1416 | 1371 | 1327 | 1228 | 1586 | 2004 | 2504 | 2640 |
| WT CD80 IgV-Fc | 3031 | 1410 | 1349 | 1309 | 1208 | 1246 | 662 | 674 | 697 | 673 | 663 |
| WT CD80 ECD-Fc (inert) | 2 (ECD) | 1344 | 1270 | 1481 | 1727 | 2202 | 692 | 705 | 847 | 875 | 1519 |
| Fc only Control | 1714 | 1404 | 1390 | 1390 | 1370 | 1373 | 689 | 675 | 666 | 694 | 679 |

Some of the exemplary assessed variant CD80-IgV Fc (effector) immunomodulatory proteins, including E35D, E35D/M43L/L70M, and A26E/E35D/M47L/L85Q, did not effect CD28 costimulation when crosslinked by binding to the FcR. However, the results indicated that several exemplary assessed variants with an Fc capable of binding FcR (effector) could provide CD28 costimulation in trans with FcR crosslinking. Among these, some of the exemplary assessed CD80-IgV Fc (effector) immunomodulatory proteins, such as E35D/M47I, enhanced CD28 costimulation via crosslinking of both PD-L1 and FcR. In some cases, the results indicated enhanced CD28 costimulation by cross-linking of FcR and PD-L1 was more potent than crosslinking of PD-L1 alone.

Example 10

Assessment of Bioactivity of Affinity-Matured CD80 IgSF Domain-Containing Molecules Using a T Cell Stimulation Assay CD80-IgV-Fc molecules, containing either an inert Fc or effector Fc, were tested at 3 concentrations, 1 nM, 10 nM and 100 nM, for their ability to stimulate T cells in the presence of artificial antigen presenting cells (aAPCs), K562/OKT3+/−PD-L1, as determined by cytokine release (IFN-gamma and IL-2) and T cell proliferation.

100,000 isolated Pan T cells were incubated with 8,000 K562/OKT3 or K562/OTK3/PD-L1 cells (12.5:1 ratio) and 1 nM, 10 nM, or 100 nM CD80-IgV-Fc (effector) or CD80-IgV-Fc (inert). The cell mixture was also incubated with an anti-PD-L1 antibody, wild-type human IgG1, human IgG Fc (inert), wild-type CD80 IgV-Fc (effector), wild-type CD80 IgV-Fc (inert), wild-type CD80 ECD-Fc (inert), wild-type CD80 ECD-Fc (effector), or no treatment as controls. IFN-gamma, IL-2 and proliferation were determined after 72 hr. incubation.

Results for IL-2 release are set forth in Table 19. In the first experiment, co-culture of T cells and K562/OKT3 aAPC (not expressing PD-L1), in the presence of certain exemplary assessed variant CD80 IgV-Fc (effector) molecules, resulted in increased IL-2 production. In a second experiment, CD28 costimulation was increased in the presence of certain variant CD80 IgV-Fc (inert) molecules upon co-culture of T cells with K562/OKT3/PD-L1 aAPCs, consistent with PD-L1-dependent CD28 costimulation activity for these variants. CD80 IgV-Fc molecules that poorly bind PD-L1 (i.e. E35G/K54E/A71D/L72P) did not generate significant costimulation and IL-2 production. In some cases, certain variant CD80 IgV-Fc (effector) molecules, like E35D, were capable of effecting CD28 costimulation only in the presence of PD-L1-expressing aAPC. IFN-gamma and proliferation results were similar to those observed for IL-2 release.

TABLE 19

Primary T Cell CD28 Costimulation via Fc Receptor-or PD-L1-Mediated Cross-Linking of CD80-IgC-Fc Molecules

| CD80 Mutation(s) | SEQ ID NO (IgV) | K562/OKT3 (No PD-L1) CD80-IgV Fc (effector) | | | K562/OKT3/PD-L1 CD80-IgV Fc (inert) | | |
|---|---|---|---|---|---|---|---|
| | | 1 nM | 10 nM | 100 nM | 1 nM | 10 nM | 100 nM |
| E35D/M47I | 177 | 11140 | 21590 | 27162 | 244 | 3432 | 8313 |
| A71D/L72V/E95K | 192 | 10593 | 15145 | 21314 | <LOD | <LOD | <LOD |
| E35D | 198 | 7598 | 7988 | 8380 | <LOD | 210 | 2739 |
| E35D/M47I/L70M | 199 | 15695 | 25997 | 25294 | 311 | 6982 | 8393 |
| E35D/M43L/L70M | 201 | 8025 | 7712 | 10496 | <LOD | 52 | 1204 |
| E35D/D46V/L85Q | 203 | 14329 | 21462 | 25421 | <LOD | 102 | 1429 |
| H18Y/A26T/E35D/A71D/L85Q | 207 | 11960 | 20452 | 20581 | <LOD | <LOD | <LOD |
| E35D/M47L | 208 | 14571 | 23581 | 26827 | 268 | 2695 | 7533 |

TABLE 19-continued

| Primary T Cell CD28 Costimulation via Fc Receptor-or PD-L1-Mediated Cross-Linking of CD80-IgC-Fc Molecules | | | | | | | |
|---|---|---|---|---|---|---|---|
| | SEQ ID NO | K562/OKT3 (No PD-L1) CD80-IgV Fc (effector) | | | K562/OKT3/PD-L1 CD80-IgV Fc (inert) | | |
| CD80 Mutation(s) | (IgV) | 1 nM | 10 nM | 100 nM | 1 nM | 10 nM | 100 nM |
| E23G/A26S/E35D/T62N/A71D/L72V/L85M | 216 | 15377 | 23462 | 27028 | <LOD | <LOD | 102 |
| E35G/K54E/A71D/L72P | 219 | 7032 | 7902 | 8886 | <LOD | <LOD | 59 |
| A26E/E35D/M47L/L85Q | 221 | 6847 | 8318 | 10113 | 72 | 268 | 1455 |
| WT CD80 IgV-Fc (effector) | 3031 | 7167 | 7123 | 6203 | Not Tested | Not Tested | Not Tested |
| WT CD80 IgV-Fc (inert) | 3031 | Not Tested | Not Tested | Not Tested | <LOD | 7 | 52 |
| WT CD80 ECD-Fc (inert) | 2 (ECD) | 8046 | 7022 | 6481 | Not Tested | Not Tested | Not Tested |
| WT CD80 ECD-Fc (effector) | 2 (ECD) | 11434 | 20185 | 23118 | 507 | 3114 | 8393 |
| Anti-PD-L1 mAb | | 8220 | 8621 | 6903 | 461 | 821 | 1045 |
| Inert Fc Control | | 7040 | 6335 | 5512 | <LOD | 143 | <LOD |
| WT IgG1 Fc Control | — | 7077 | 6916 | 6258 | Not Tested | Not Tested | Not Tested |

Example 11

Figure 9D:
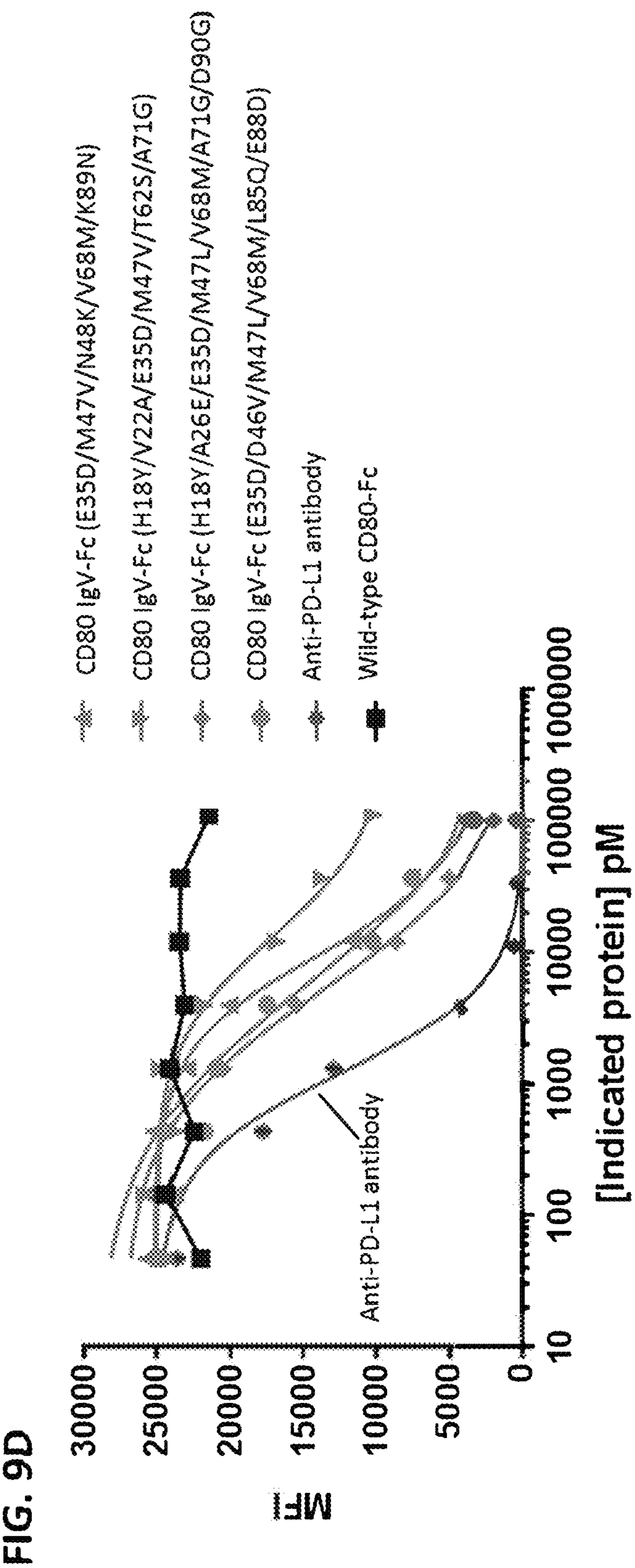
FIG. 9D depicts the ability of exemplary CD80 IgV-Fc candidates to bind PD-L1 and block fluorescently conjugated PD-1 binding.

Assessment of Variant CD80 Polypeptides Blocking PD-L1/PD-1 Interaction or PD-L1-Dependent Costimulation A. PD-L1/PD-1 Binding and Blocking Binding of selected immunomodulatory fusion proteins to cells expressing PD-L1 was assessed to test for blocking of the PD-L1/PD-1 interaction. CHO/PD-L1 cells were stained with a titration of variant CD80 IgV-Fc domain-containing molecules, washed and then incubated with fluorescently conjugated PD-1-Fc. Exemplary variant CD80 IgV domain-containing molecules tested contained E35D/M47V/N48K/V68M/K89N (SEQ ID NO: 2250), H18Y/V22A/E35D/M47V/T62S/A71G (SEQ ID NO: 2275), H18Y/A26E/E35D/M47L/V68M/A71G/D90G (SEQ ID NO: 2276), and E35D/D46V/M47L/V68M/L85Q/E88D (SEQ ID NO: 2280). As a control, an anti-PD-L1 antibody and a wild-type CD80 IgV-Fc were also assessed. Samples were acquired on a flow cytometer and MFIs of the fluorescently labeled PD-1 were determined by Flowjo software analysis. As shown in FIG. 9D, the exemplary variant CD80 IgV-Fc molecules tested were shown to antagonize or block binding of PD-1 to PD-L1.

B. Activity

Exemplary variant CD80-Fc polypeptides were assessed for their ability to deliver PD-L1 dependent costimulation using Jurkat/IL-2 reporter cells, expressing PD-1, as described above. The Jurkat/IL-2 reporter cells were incubated with K562/OKT3/PD-L1 artificial antigen presenting cells (aAPCs), described above, in the presence of titrated amounts (ranging from 40 pM to 100 nM) of exemplary variant CD80 IgV-Fc polypeptides. Among the exemplary variant CD80 IgV-Fc polypeptides were molecules containing a variant IgV, either E35D/M47V/N48K/V68M/K89N (SEQ ID NO: 2250), H18Y/V22A/E35D/M47V/T62S/A71G (SEQ ID NO:2275), H18Y/A26E/E35D/M47L/V68M/A71G/D90G (SEQ IN NO: 2276), or E35D/D46V/M47L/V68M/L85Q/E88D (SEQ ID NO:2280), fused to the exemplary Fc (C220S/L234A/L235E/G237A by EU numbering; SEQ ID NO:1714). Other tested variant CD80 IgV-Fc polypeptides contained a variant IgV, either E35D/M47I/L70M, SEQ ID NO:199; or E35D/M47L, SEQ ID NO:208) fused to wild-type IgG1 (SEQ ID NO: 1429). As a control, PD-L1-expressing cells were also incubated with wild-Type CD80 IgV-Fc (SEQ ID NO:3031) or with an anti-PDL1 antibody (BioLegend USA).

Jurkat/IL-2/PD-1 reporter cells were plated at 100,000 cells per well in Jurkat Assay buffer (RPMI1640+5% FBS). The Jurkat cells were then incubated with test or control proteins for 15 minutes at room temperature. K562/OKT3/PD-L1 cells were then added such that each well had a final ratio of 5:1 Jurkat: K562 cells. Jurkat cells, K562 cells, and test or control proteins were incubated for 5 hours at 37 degrees Celsius in a humidified 5% $CO_2$ incubation chamber. Plates were then removed from the incubator and acclimated to room temperature for 15 minutes. 100 μL of a cell lysis and luciferase substrate solution (BioGlo luciferase reagent, Promega) were added to each well and the plates were incubated on an orbital shaker for 10 minutes. Luminescence was measured with a 1 second per well integration time using a BioTek Cytation luminometer, and a fold increase in luminescence value (RLU) was determined for each test sample.

Figure 9E:
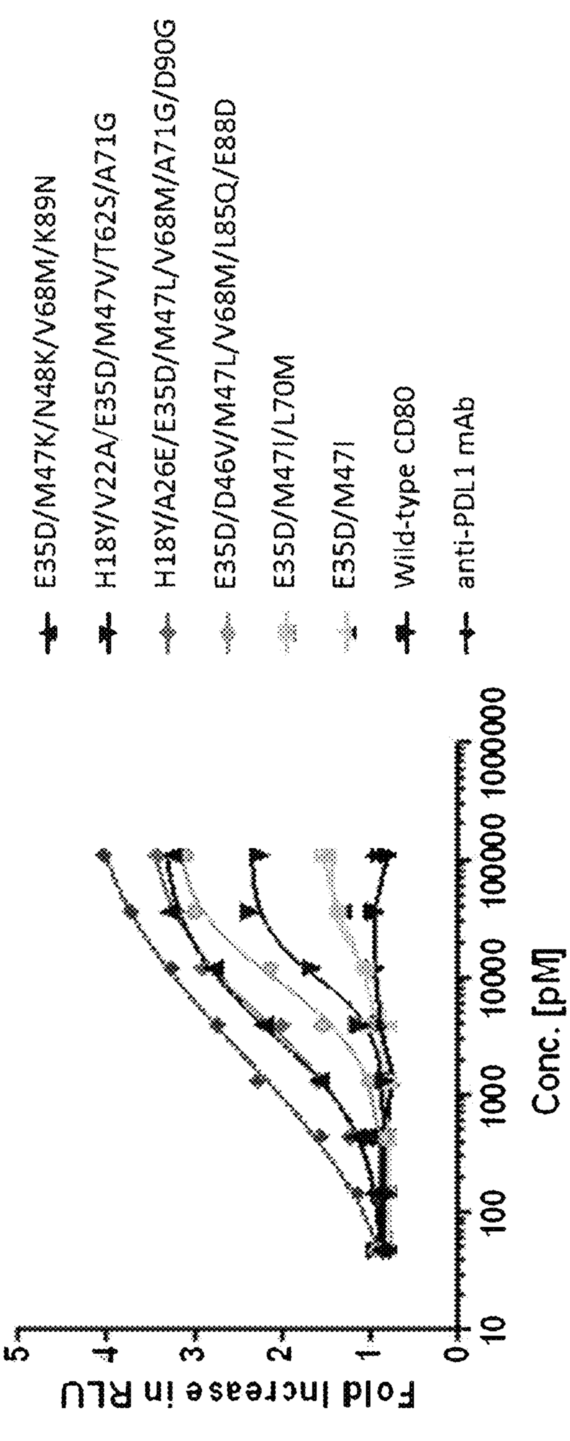
FIG. 9E depicts the PD-1/PD-L1 interaction and subsequent functional activity antagonistic activity of exemplary variant CD80-Fc variants.

As shown in FIG. 9E, the addition of the exemplary assessed variant CD80 IgV-Fc, blocked PD-L1 mediated suppression of the TCR activation and/or agonized CD28, resulting in increased luminescence. Variant molecules identified for increased binding affinity to PD-L1 exhibited greater activity in agonizing T cell activation.

Example 12

In Vivo Anti-Tumor Activity of Variant CD80 Polypeptides

A. Anti-Tumor Activity of CD80 Variants

Mouse MC38 tumor cells were stably transfected with human PD-L1 (MC38 hPD-L1) and implanted subcutaneously into C57BL/6 mice. An inert Fc control or exemplary variant CD80 IgV-Fc molecules, containing a variant IgV (E35D/M47I/L70M, SEQ ID NO:199; or E35D/M47L, SEQ ID NO:208) fused to either an inert Fc molecule (e.g. SEQ ID NO:1714) or an Fc molecule capable of mediating effector activity (SEQ ID NO:1429), were injected i.p., 100 μg/mouse, on days 8, 10, 13, 15 and 17 post-implantation. Tumor volume was tracked over time.

Figure 10:
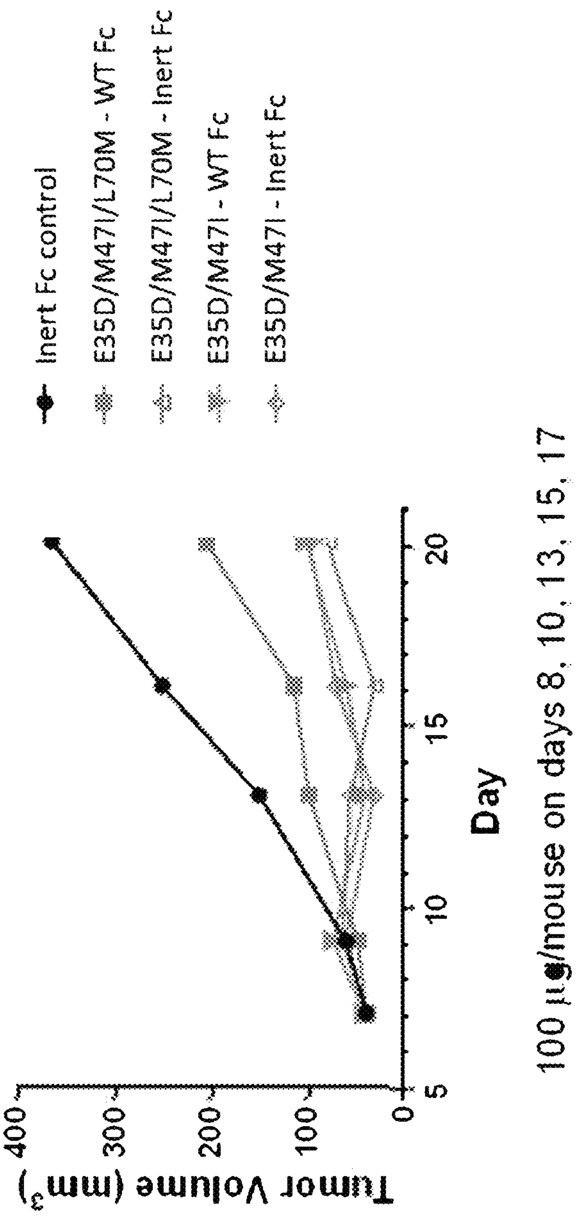
FIG. 10 depicts the in vivo anti-tumor activity of exemplary variant CD80 polypeptides fused to wild-type IgG1 Fc (WT Fc) or inert IgG1 Fc (inert Fc).

As shown in FIG. 10, suppression of tumor growth was observed in all mice treated with CD80-IgV compared to the Fc control, demonstrating that the variant CD80 IgV-Fc molecules were functionally active in vivo.

B. Dose Dependency of Anti-Tumor Activity

1. Tumor Volume (50Ug, 100Ug, and 500Ug Doses)

70 female C57CL/6 mice, containing similar tumor volumes of approximately 50-51 $mm^3$, following implantation of MC38 hPD-L1 tumor cells, were staged and divided into 5 treatment groups containing 14 mice each. Group 1 (isotype control) received 75 μg F only (SEQ ID NO: 1714); Groups 2, 3 and 4 received 50, 100, and 500 μg, respectively, CD80 variant E35D/M47L (SEQ ID NO: 208) fused to an inert human Fc (SEQ ID NO: 1714) via a GSG4S linker (SEQ ID NO: 1716); and Group 5 received 100 μg human anti-PD-L1 mAb (durvalumab), on days 8, 10, and 12. Tumor volumes were measured on days 7, 10, and 12. On day 13, 5 animals were sacrificed for analysis as described in the sections below. Tumor measurements resumed for the remaining 9 mice for each group on days 17, 20 and 27. On days 26, 28, and 31, the animals in Group 1 (Fc isotype control) received an intratumoral injection of 100 μg E35D/M47L CD80-IgV-Fc.

Figure 11:
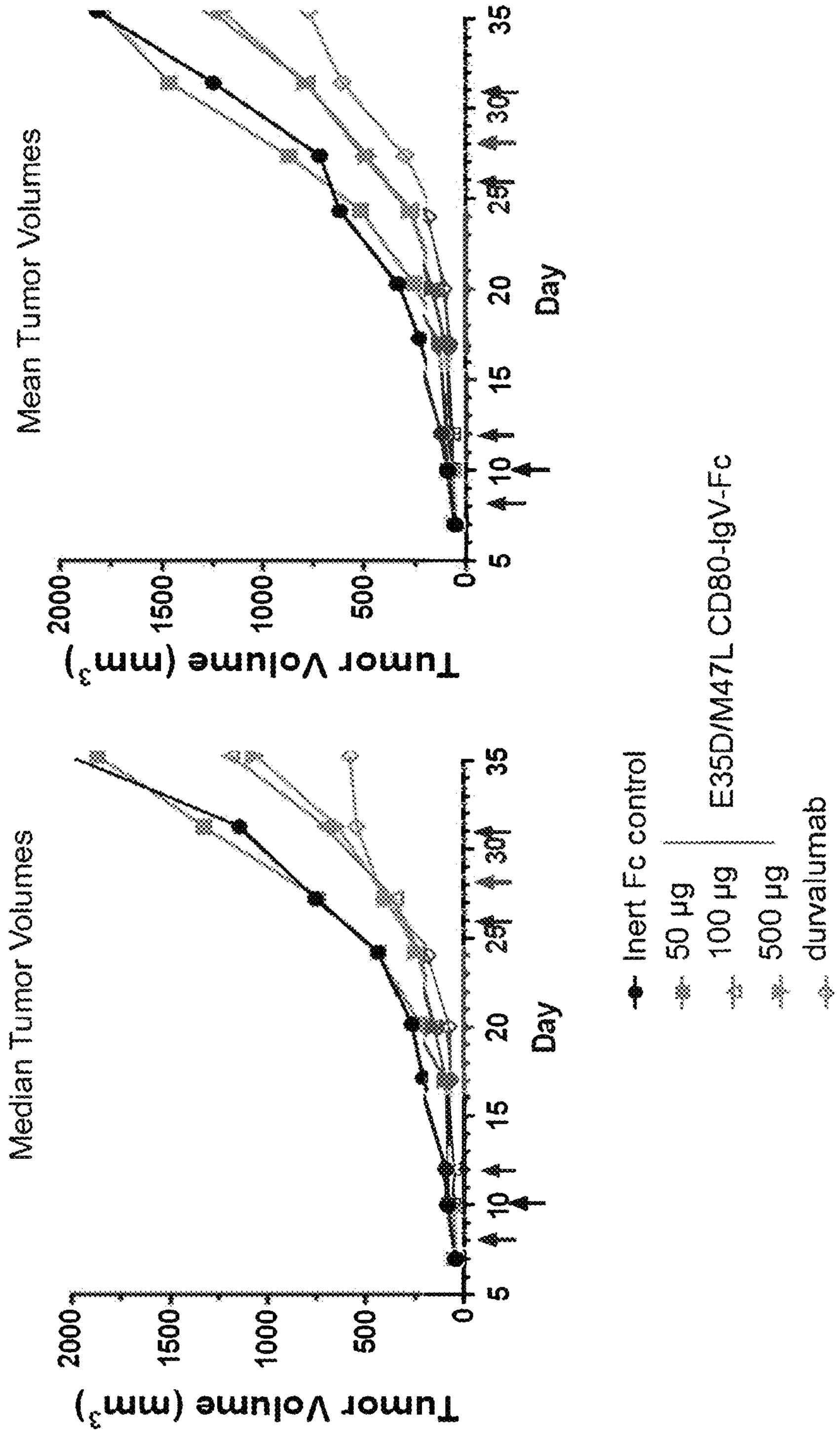
FIG. 11 depicts the median (left panel) and mean (right panel) tumor volumes in a mouse model following treatment with 50 μg, 100 μg, and 500 μg of an exemplary variant CD80 IgV-Fc (inert) and 100 μg anti-PD-L1 antibody (durvalumab).

The median and mean tumor volumes are depicted in FIG. 11. As shown, a dose-dependent decrease in tumor volumes were observed in treated with CD80-IgV-Fc compared to the Fc control. In this study, the median tumor volume observed in mice treated with the 100 μg to 500 μg CD80-IgV-Fc was similar to mice treated with the anti-PD-L1 antibody control.

2. Cytokine Analysis

Figure 12:
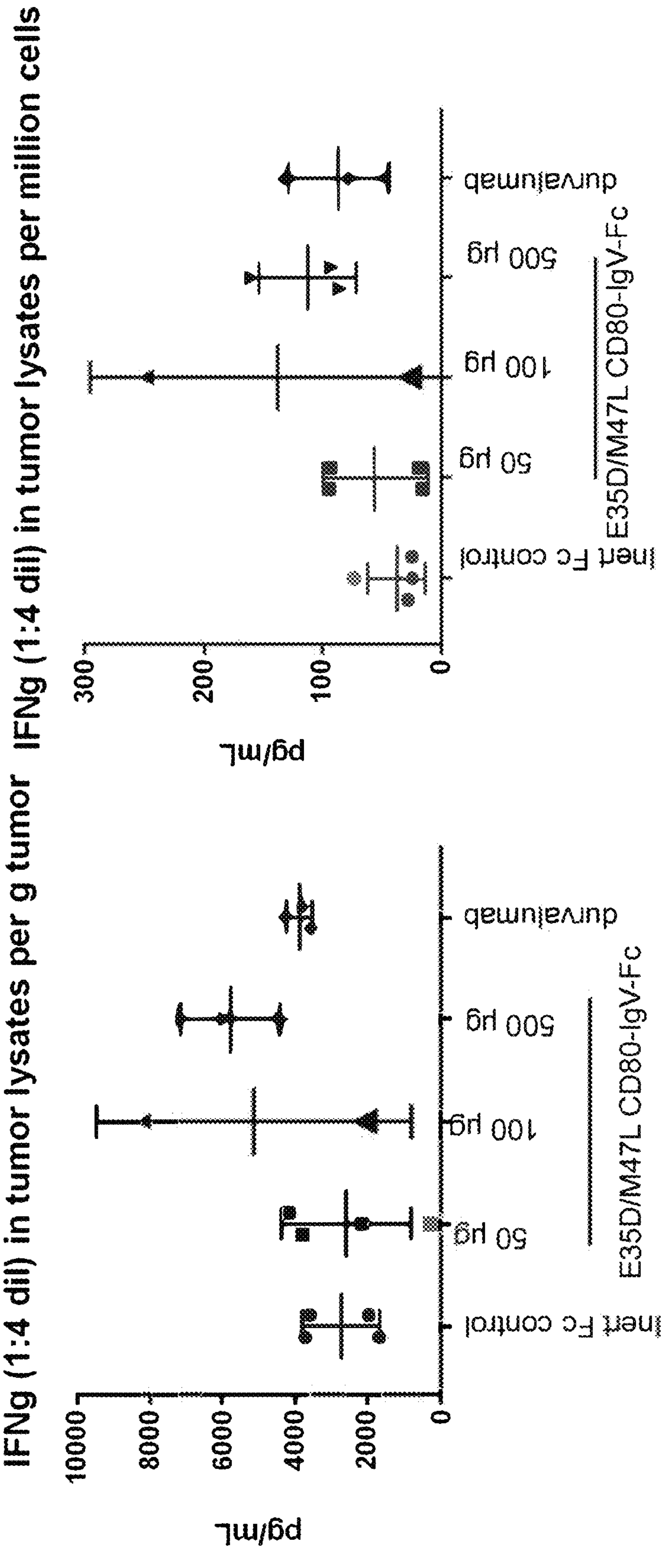
FIG. 12 depicts concentration of IFNγ in hPD-LIMC38 tumor lysates following in vivo treatment with 50 μg, 100 μg, and 500 μg of an exemplary variant CD80 IgV-Fc (inert) and 100 μg anti-PD-L1 antibody (durvalumab).

Following the enzymatic digestion of MC38 tumors, the lysate solution was centrifuged, and the supernatants collected and stored at −80° C. until ready for assay. The concentration of mouse IFNγ in each sample was then measured using a commercial ELISA kit (R&D Systems, Inc.) according to manufacturer's instructions, and concentrations were normalized based on either tumor weight or total cell number isolated from tumor. Results, set forth in FIG. 12, indicated that the highest dose (500 μg) of E35D/M47L CD80-IgV-Fc resulted in the highest concentrations of IFNγ in the tumor lysates, suggesting that the CD80-IgV-Fc is producing IFNγ as a result of its treatment, a mechanism that is known to promote anti-tumor immunity.

C. Anti-Tumor and Rechallenge Activity of CD80 Selected Variants 95 female C57BL/6 mice were implanted with MC38 hPD-L1 tumor cells. The tumors were staged on Day 7, and 77 mice with similar tumor volumes of approximately 60 $mm^3$ were divided into 7 treatment groups containing 11 mice each. Group 1 (Isotype control) received 75 μg inert Fc only (SEQ ID NO: 1714); Group 2 received 100 μg CD80 variant E35D/M47V/N48K/V68M/K89N IgV (SEQ ID NO: 2250)-Fc (inert); Group 3 received 100 μg CD80 variant H18Y/A26E/E35D/M47L/V68M/A71G/D90G IgV (SEQ ID NO: 2276)-Fc (inert); Group 4 received 100 μg CD80 variant E35D/D46V/M47L/V68M/L85Q/E88D IgV (SEQ ID NO: 2280)-Fc (inert); Group 5 received 100 μg CD80 variant E35D/D46E/M47V/V68M/D90G/K93E IgV (SEQ ID NO: 2284)-Fc (inert); Group 6 received 100 μg CD80 variant E35D/M47L (SEQ ID NO: 208)-Fc (inert); and Group 7 received 100 μg human anti-PD-L1 mAb (durvalumab), on days 7, 9 and 11. For the variant CD80-IgV-Fc molecules, the CD80IgV domains were fused to inert human Fc, set forth in SEQ ID NO: 1714, via a GSG4S linker (SEQ ID NO: 1716). Tumor volumes were measured on days 14, 17, 21, 24, 28, 31, and 37. Animals receiving the Fe isotype control were terminated by day 28 due to excess tumor burden.

Figure 13:
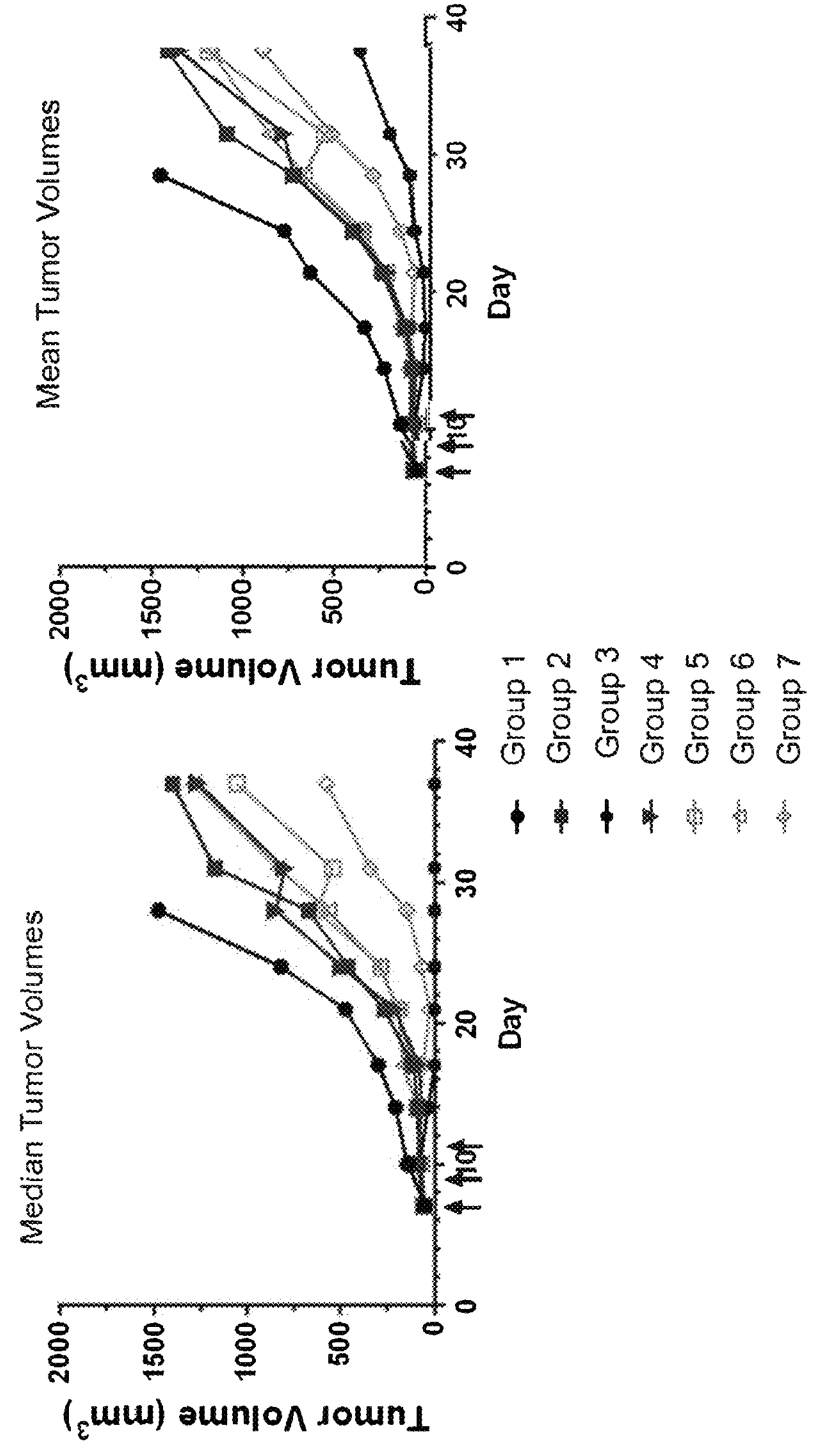
FIG. 13 depicts the median (left panel) and mean (right panel) tumor volumes in a mouse model following treatment with multiple exemplary CD80 IgV-Fc (inert) variants and anti-PD-L1 antibody (durvalumab).

The median and mean tumor volumes are depicted in FIG. 13, which shows that all tested CD80-IgV-Fc molecules exhibited similar or, in some cases, substantially improved activity compared to the anti-PD-L1 control. Upon completion of the study, 8 mice from Group 3, 2 mice from Group 4, 1 mouse from Group 6, and 2 mice from Group 7 no longer had detectable tumors and were designated "tumor-free."

Figure 14:
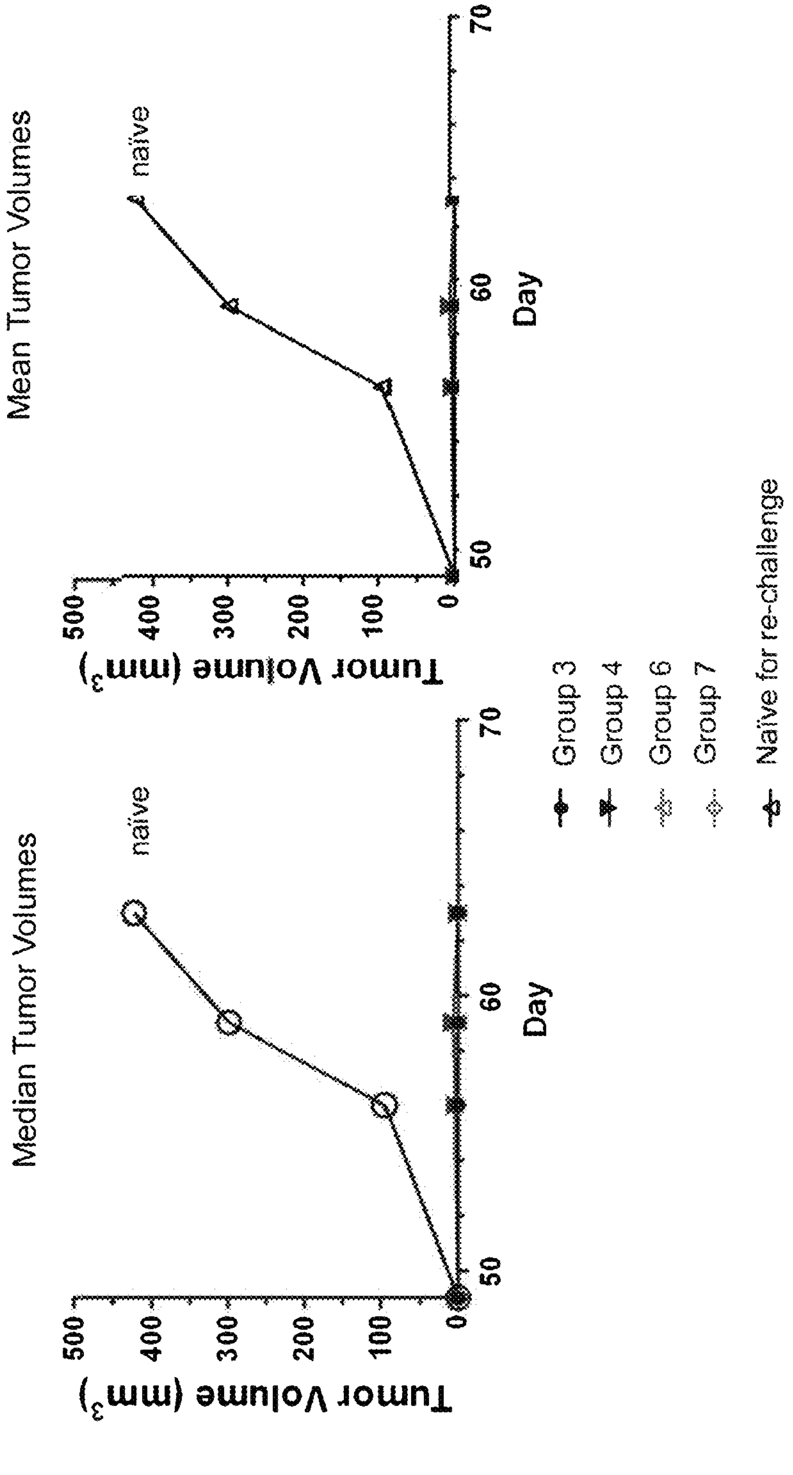
FIG. 14 depicts the median (left panel) and mean (right panel) tumor volumes in mice, designated tumor-free post-treatment with exemplary CD80 IgV-Fc (inert) variants and anti-PD-L1 antibody (durvalumab), following re-challenge with huPD-L1/MC38 tumor cells.

On day 49, tumor-free mice, from Groups 3, 4, 6, and 7, and 2 naïve C57CL/6 mice were re-challenged with an additional injection of hPD-L1 MC38 cells. Tumor volumes were measured on days 56, 59, and 63. The results are depicted in FIG. 14. Naïve mice exhibited rapid tumor growth, as expected. At day 59, 8/8 mice from Group 3, 1/2 mice from Group 4, 1/1 mouse from Group 6, and 2/2 mice from Group 7 were tumor-free, and by day 63, all mice in Group 3, Group 4, Group 6, and Group 7 were tumor-free. This result is consistent with an observation that the tested agents, including CD80-IgV-Fc molecules, were able to provide long-lasting, durable immunity, anti-tumor effects.

Figure 15:
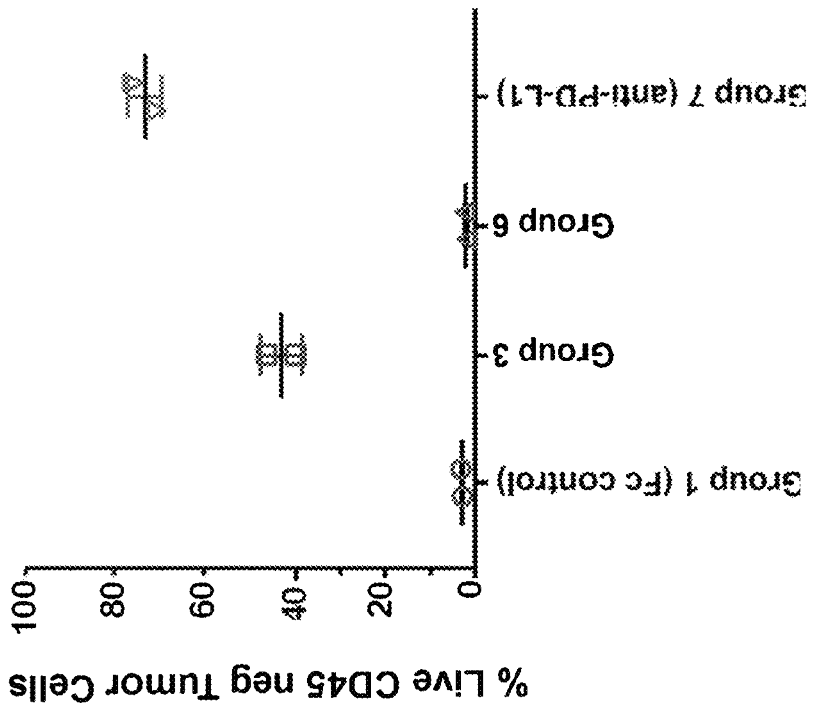
FIG. 15 depicts detection of bound negative control Fc, CD80 variant-Fc, and anti-PD-L1 antibody by flow cytometry on single cell suspensions of live CD45 negative (CD45 neg.; CD45-) tumor cells.

Tumors from mice sacrificed 3 days after the second dose were digested and live CD45− tumor cells were analyzed for the presence of bound inert Fc, CD80 variant-Fc, and anti-PD-L1 antibody by flow cytometry. The results for Groups 1, 3, 6 and 7 are provided in FIG. 15. Similar to the study described above, the results showed that the CD80-IgV-Fc molecules exhibited less binding to the tumor compared to the anti-PD-L1 antibody control. Despite this, superior activity by CD80-IgV-Fc, such as shown by mice treated with the exemplary CD80-IgV-Fc set forth in SEQ ID NO: 2276 (H18Y/A26E/E35D/M47L/V68M/A71G/D90G), could be achieved consistent with the differentiating factor in activity being due to CD28 agonism (PD-L1-dependent CD28 costimulation) and/or CTLA-4 antagonism.

D. Anti-Tumor Activity of CD80 variant and anti-PD-L1 Antibody 75 animals were staged into 3 treatment groups 7 days after implantation with hPD-L1 MC38 tumor cells. Group 1 received 3 injections of 75 μg inert Fc (SEQ ID NO: 1714), Group 2 received 3 injections of 100 μg CD80 variant H18Y/A26E/E35D/M47L/V68M/A71G/D90G IgV (SEQ ID NO: 2276)-Fc (inert), and Group 3 received 3 injections of 100 μg of human anti-PD-L1 mAb (durvalumab), with the injections taking place on Days 8, 10 and 12 after implantation. Tumor volumes were measured every 3-4 days, from Day 11 until Day 35. 3 days after the $1^{st}$ dose, $2^{nd}$ dose and $3^{rd}$ dose, 4 mice from each group were sacrificed for tumor and LN analyses, leaving 13 mice for tumor volume measurements throughout the study period.

Figure 16:
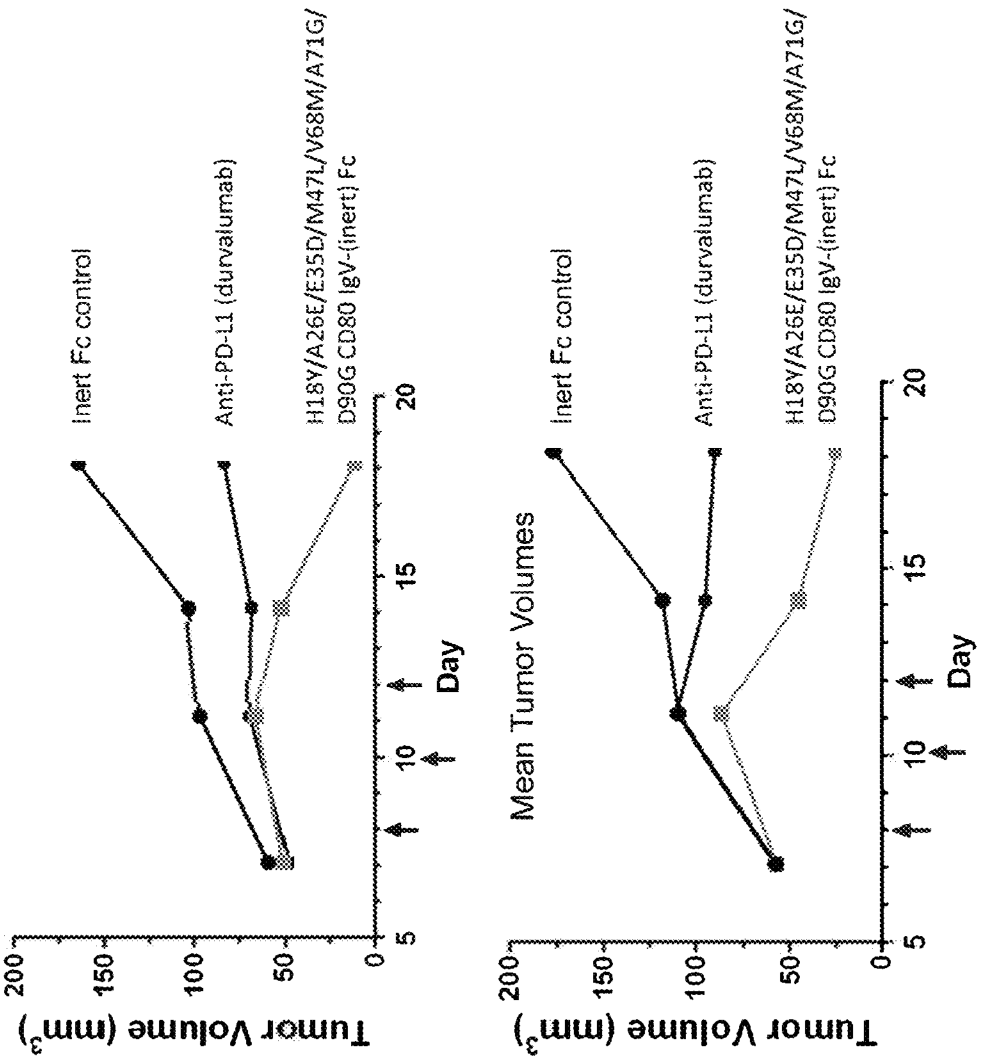
FIG. 16 depicts the median (left panel) and mean (right panel) tumor volumes in a mouse model following treatment with an exemplary variant CD80 IgV-Fc (inert) and anti-PD-L1 antibody (durvalumab).

FIG. 16 shows a greater decrease in the median and mean tumor volumes of mice treated in this study with the exemplary CD80-IgV-Fc compared to the anti-PD-L1 control. On Day 18, 0/13 mice of Group 1 (Fc control-treated) were tumor-free, 6/13 mice of Group 2 (CD80 variant IgV-Fc-treated) were tumor-free, and 3/13 mice of Group 3 (durvalumab-treated) were tumor-free. At day 35, 1/13, 6/13, and 3/13 mice were tumor free in Groups 1, 2, and 3, respectively. Mice treated with the variant CD80-IgV-Fc exhibited tumors that on average were reduced in size compared to tumors of mice treated with anti-hPD-L1 antibody or the inert Fc control.

1. Tumor Cell Characterization

Three days following the 2nd dose of the Fc control, the CD80 variant IgV-Fc, and anti-PD-L1 antibody (durvalumab), tumors and draining lymph nodes (LN) were harvested from 3-4 mice from each treatment group. Tissues were processed to single cell suspensions (tumors were enzymatically digested as a part of the processing, whereas draining LN were not), and subjected to multi-color flow cytometric analysis of CD8+ T cells on the CD45+ cell subset (immune cells in either the LN or tumor), as well as % hIgG+ staining on the CD45− cell subset (tumor cells) to detect molecules (CD80-IgV-Fc or anti-PD-L1) bound to the tumor cells. The results are provided in FIG. 17A-C.

Figures 17A, 17B, 17C:
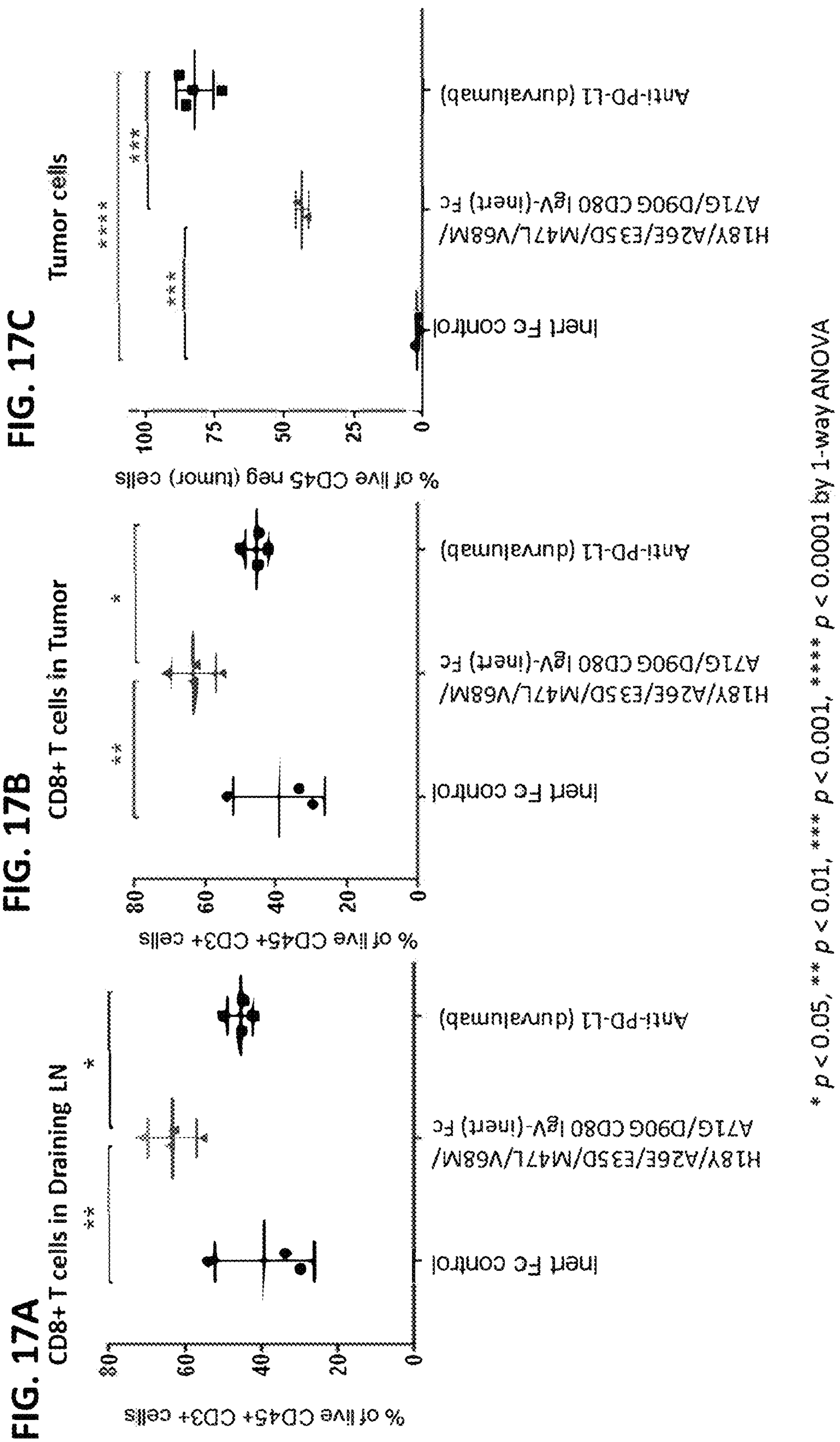
FIGS. 17A and 17B depict percentage of CD8 cells detected by flow cytometry in the tumor draining lymph node (A) and tumor (B) of mice treated with negative control Fc, CD80 variant-Fc, and anti-PD-L1 antibody.
FIG. 17C represents the percentage of anti-human Fc detected reagents on CD45 negative tumors treated in vivo with negative control Fc, CD80 IgV-Fc, and human anti-PD-L1 antibody.

The percentages of CD8+ T cells were significantly greater ($p<0.05$ or $p<0.01$) in both the TIL and the LN for mice treated with H18Y/A26E/E35D/M47L/V68M/A71G/D90G CD80-IgV-Fc as compared to the Fc control or the anti-PD-L1 antibody treatments (FIGS. 17A (LN) and 17B (tumor). This indicates that H18Y/A26E/E35D/M47L/V68M/A71G/D90G CD80-IgV-Fc treatment can promote CD8+ T cell expansion in vivo, an important contributor to anti-tumor immunity. Furthermore, H18Y/A26E/E35D/M47L/V68M/A71G/D90G CD80-IgV-Fc was detected on the tumor (ex vivo via hIgG+ staining on CD45− cells) though at reduced levels as compared to those of the anti-PD-L1 antibody (FIG. 17C). Despite reduced presence of E35D/M47L CD80-Fc on the tumor, compared to anti-PD-L1 detected, the anti-tumor activity was superior for the CD80-Fc as compared to the anti-PD-L1 antibody (see section B1 above section). These results are consistent with an observation that the activity of CD80-IgV-Fc may not be only to PD-L1/PD-1 antagonism, but that the differentiating factor may relate to CD28 agonism (PD-L1-dependent CD28 costimulation) and/or CTLA4 antagonism activities.

Example 13

Generation of Additional Variant CD8 IgV Domains

A. Additional CD8 IgV Binding Domains and Binding Assessment

Additional CD80 variants were generated and expressed as Fc fusion proteins essentially as described in Examples 2-5. The variants were tested for binding, substantially as described in Example 7, and bioactivity, substantially described in Example 9. Results from the binding and activity studies are provided in Tables 20-23.

1. Binding Assessment

TABLE 20

Flow Binding to Jurkats (CD28) and CHO cells stably expressing CTLA4 or PD-L1

| CD80 Mutation(s) | SEQ ID NO: | CTLA4 MFI at 33.3 nM | CTLA4 Fold change to WT CD80 | CD28 MFI at 33.3 nM | CD28 Fold change to WT CD80 | PD-L1 MFI at 33.3 nM | PD-L1 Fold change to WT CD80 | Ratio of PDL1: CD28 |
|---|---|---|---|---|---|---|---|---|
| E35D/N48K/L72V | 2719 | 32731 | 17.1 | 582 | 8.8 | 3031 | 43.1 | 5 |
| E35D/T41S/N48T | 2720 | 30262 | 15.8 | 72.4 | 1.1 | 2191 | 31.2 | 30 |
| D46V/M47I/A71G | 2721 | 28420 | 14.8 | 1325 | 20.1 | 7328 | 104.2 | 6 |
| M47I/A71G | 2722 | 27768 | 14.5 | 823 | 12.5 | 5097 | 72.5 | 6 |
| E35D/M43I/M47L/L85M | 2723 | 24584 | 12.8 | 265 | 4.0 | 4878 | 69.4 | 18 |
| E35D/M43I/D46E/A71G/L85M | 2724 | 26878 | 14.0 | 200 | 3.0 | 7138 | 101.5 | 36 |
| H18Y/E35D/M47L/A71G/A91S | 2725 | 24218 | 12.6 | 528 | 8.0 | 7582 | 107.9 | 14 |
| E35D/M47I/N48K/I61F | 2726 | 25859 | 13.5 | 816 | 12.4 | 5627 | 80.0 | 7 |
| E35D/M47V/T62S/L85Q | 2727 | 31230 | 16.3 | 99.4 | 1.5 | 6653 | 94.6 | 67 |
| M43I/M47L/A71G | 2728 | 23292 | 12.2 | 1000 | 15.2 | 7763 | 110.4 | 8 |
| E35D/M47V | 2729 | 20893 | 10.9 | 461 | 7.0 | 2935 | 41.7 | 6 |
| E35D/M47L/A71G/L85M | 2730 | 16609 | 8.7 | 199 | 3.0 | 8312 | 118.2 | 42 |
| V22A/E35D/M47L/A71G | 2731 | 21855 | 11.4 | 990 | 15.0 | 8168 | 116.2 | 8 |
| E35D/M47L/A71G | 2732 | 20576 | 10.7 | 626 | 9.5 | 6635 | 94.4 | 11 |
| E35D/D46E/M47I | 2733 | 21394 | 11.2 | 1001 | 15.2 | 3789 | 53.9 | 4 |
| Q27H/E35D/M47I | 2734 | 27530 | 14.4 | 756 | 11.5 | 3424 | 48.7 | 5 |
| E35D/D46E/L85M | 2735 | 30289 | 15.8 | 164 | 2.5 | 2880 | 41.0 | 18 |
| E35D/D46E/A91G | 2736 | 32189 | 16.8 | 3450 | 52.3 | 2818 | 40.1 | 1 |
| E35D/D46E | 2737 | 27921 | 14.6 | 779 | 11.8 | 3757 | 53.4 | 5 |
| E35D/L97R | 2738 | 22803 | 11.9 | 44.6 | 0.7 | 2614 | 37.2 | 59 |
| H18Y/E35D | 2739 | 26258 | 13.7 | 479 | 7.3 | 3526 | 50.2 | 7 |
| Q27L/E35D/M47V/I61V/L85M | 2740 | 27881 | 14.6 | 230 | 3.5 | 2705 | 38.5 | 12 |
| E35D/M47V/I61V/L85M | 2741 | 28848 | 15.1 | 274 | 4.2 | 3054 | 43.4 | 11 |
| E35D/M47V/L85M/R94Q | 2742 | 23334 | 12.2 | 23.7 | 0.4 | 3039 | 43.2 | 128 |
| E35D/M47V/N48K/L85M | 2743 | 11792 | 11.5 | 413 | 10.0 | 5660 | 67.9 | 14 |
| H18Y/E35D/M47V/N48K | 2744 | 11747 | 11.4 | 841 | 20.4 | 6462 | 77.5 | 8 |
| WT CD80 ECD-Fc H22.6 | 2 | 31563 | 16.5 | 43 | 0.7 | 46.3 | 0.7 | 1 |
| CD80 WT IgV-Fc | 3031 | 1916 | 1.0 | 66 | 1.0 | 70.3 | 1.0 | 1 |
| Inert Fc | 1714 | 65.7 | 0.0 | 23 | 0.4 | 41 | 0.6 | 2 |

TABLE 21

Flow Binding to Jurkats (CD28) and CHO cells stably expressing CTLA4 or PD-L1

| CD80 Mutation(s) | SEQ ID NO | CTLA4 MFI at 33.3 nM | CTLA4 Fold change to WT CD80 | CD28 MFI at 33.3 nM | CD28 Fold change to WT CD80 | PD-L1 MFI at 33.3 nM | PD-L1 Fold change to WT CD80 | Ratio of PDL1: CD28 |
|---|---|---|---|---|---|---|---|---|
| E24D/E35D/M47L/V68M/E95V/L97Q | 2765 | 15505 | 8.8 | 15 | 0.5 | 18649 | 362.1 | 1268.6 |
| E35D/D46E/M47I/T62A/V68M/L85M/Y87C | 2766 | 16987 | 9.7 | 486 | 15.5 | 18734 | 363.8 | 38.5 |
| E35D/D46E/M47I/V68M/L85M | 2767 | 14036 | 8.0 | 353 | 11.2 | 16341 | 317.3 | 46.3 |
| E35D/D46E/M47L/V68M/A71G/Y87C/K93R | 2768 | 15098 | 8.6 | 425 | 13.5 | 24297 | 471.8 | 57.2 |
| E35D/D46E/M47L/V68M/T79M/L85M | 2769 | 15049 | 8.6 | 403 | 12.8 | 8641 | 167.8 | 21.4 |
| E35D/D46E/M47L/V68M/T79M/L85M/L97Q | 2770 | 96 | 0.1 | 14 | 0.5 | 4617 | 89.7 | 325.1 |
| E35D/D46E/M47V/V68M/L85Q | 2771 | 15533 | 8.9 | 1740 | 55.4 | 1723 | 33.5 | 1.0 |
| E35D/M43I/M47L/V68M | 2772 | 16243 | 9.3 | 1517 | 48.3 | 16912 | 328.4 | 11.1 |
| E35D/M47I/V68M/Y87N | 2773 | 17860 | 10.2 | 3553 | 113.2 | 13145 | 255.2 | 3.7 |
| E35D/M47L/V68M/E95V/L97Q | 2774 | 14955 | 8.5 | 14 | 0.5 | 18600 | 361.2 | 1300.7 |
| E35D/M47L/Y53F/V68M/A71G/K93R/E95V | 2775 | 16013 | 9.1 | 383 | 12.2 | 25024 | 485.9 | 65.3 |
| E35D/M47V/N48K/V68M/A71G/L85M | 2776 | 16604 | 9.5 | 302 | 9.6 | 22770 | 442.1 | 75.4 |
| E35D/M47V/N48K/V68M/L85M | 2777 | 15581 | 8.9 | 245 | 7.8 | 7618 | 147.9 | 31.1 |
| E35D/M47V/V68M/L85M | 2778 | 15997 | 9.1 | 201 | 6.4 | 9177 | 178.2 | 45.7 |
| E35D/M47V/V68M/L85M/Y87D | 2779 | 13936 | 7.9 | 509 | 16.2 | 1721 | 33.4 | 3.4 |
| E35D/T41S/D46E/M47I/V68M/K93R/E95V | 2780 | 18369 | 10.5 | 476 | 15.2 | 14790 | 287.2 | 31.1 |
| H18Y/E35D/D46E/M47I/V68M/R94L | 2781 | 23300 | 13.3 | 244 | 7.8 | 18806 | 365.2 | 77.1 |
| H18Y/E35D/M38I/M47L/V68M/L85M | 2782 | 139 | 0.1 | 16.7 | 0.5 | 3589 | 69.7 | 214.9 |
| H18Y/E35D/M47I/V68M/Y87N | 2783 | 18626 | 10.6 | 4038 | 128.6 | 14988 | 291.0 | 3.7 |
| H18Y/E35D/M47L/V68M/A71G/L85M | 2784 | 19541 | 11.1 | 437 | 13.9 | 18669 | 362.5 | 42.7 |
| H18Y/E35D/M47L/V68M/E95V/L97Q | 2785 | 20475 | 11.7 | 14.5 | 0.5 | 14750 | 286.4 | 1017.2 |
| H18Y/E35D/M47L/Y53F/V68M/A71G | 2786 | 146 | 0.1 | 15.7 | 0.5 | 5105 | 99.1 | 325.2 |
| H18Y/E35D/M47L/Y53F/V68M/A71G/K93R/E95V | 2787 | 18356 | 10.5 | 334 | 10.6 | 23390 | 454.2 | 70.0 |
| H18Y/E35D/M47V/V68M/L85M | 2788 | 18367 | 10.5 | 373 | 11.9 | 16774 | 325.7 | 45.0 |
| H18Y/E35D/V68M/A71G/R94Q/E95V | 2789 | 18281 | 10.4 | 16 | 0.5 | 14990 | 291.1 | 954.8 |
| H18Y/E35D/V68M/L85M/R94Q | 2790 | 19766 | 11.3 | 14 | 0.4 | 14410 | 279.8 | 1036.7 |
| H18Y/E35D/V68M/T79M/L85M | 2791 | 16287 | 9.3 | 1041 | 33.2 | 14907 | 289.5 | 14.3 |
| H18Y/V22D/E35D/M47V/N48K/V68M | 2792 | 15798 | 9.0 | 257 | 8.2 | 12867 | 249.8 | 50.1 |
| Q27L/Q33L/E35D/T41S/M47V/N48K/V68M/L85M | 2793 | 178 | 0.1 | 15 | 0.5 | 16492 | 320.2 | 1129.6 |
| Q33L/E35D/M47V/T62S/V68M/L85M | 2794 | 86 | 0.0 | 15 | 0.5 | 16838 | 327.0 | 1107.8 |
| Q33R/E35D/M38I/M47L/V68M | 2795 | 107 | 0.1 | 15 | 0.5 | 16502 | 320.4 | 1107.5 |
| R29C/E35D/M47L/V68M/A71G/L85M | 2796 | 91 | 0.1 | 16 | 0.5 | 16251 | 315.6 | 997.0 |
| S21P/E35D/K37E/D46E/M47I/V68M | 2797 | 20616 | 11.8 | 540 | 17.2 | 17833 | 346.3 | 33.0 |
| S21P/E35D/K37E/D46E/M47I/V68M/R94L | 2798 | 20142 | 11.5 | 284 | 9.0 | 17789 | 345.4 | 62.6 |
| T13R/E35D/M47L/V68M | 2799 | 21255 | 12.1 | 15.6 | 0.5 | 19969 | 387.7 | 1280.1 |
| T13R/Q27L/Q33L/E35D/T41S/M47V/N48K/V68M/L85M | 2801 | 109 | 0.1 | 14.6 | 0.5 | 3272 | 63.5 | 224.1 |
| T13R/Q33L/E35D/M47L/V68M/L85M | 2802 | 141 | 0.1 | 15.7 | 0.5 | 3228 | 62.7 | 205.6 |
| T13R/Q33L/E35D/M47V/T62S/V68M/L85M | 2803 | 105 | 0.1 | 16 | 0.5 | 3968 | 77.0 | 248.0 |
| T13R/Q33R/E35D/M38I/M47L/V68M | 2804 | 193 | 0.1 | 13.8 | 0.4 | 4482 | 87.0 | 324.8 |
| T13R/Q33R/E35D/M38I/M47L/V68M/E95V/L97Q | 2805 | 20652 | 11.8 | 1111 | 35.4 | 19157 | 372.0 | 17.2 |
| T13R/Q33R/E35D/M38I/M47L/V68M/L85M | 2806 | 22011 | 12.6 | 14.2 | 0.5 | 1106 | 21.5 | 77.9 |
| T13R/Q33R/E35D/M38I/M47L/V68M/L85M/R94Q | 2807 | 19105 | 10.9 | 15.2 | 0.5 | 20366 | 395.5 | 1339.9 |
| T13R/Q33R/E35D/M47L/V68M | 2808 | 20738 | 11.8 | 14.1 | 0.4 | 14680 | 285.0 | 1041.1 |

TABLE 21-continued

Flow Binding to Jurkats (CD28) and CHO cells stably expressing CTLA4 or PD-L1

| | | CTLA4 | | CD28 | | PD-L1 | | |
|---|---|---|---|---|---|---|---|---|
| CD80 Mutation(s) | SEQ ID NO | MFI at 33.3 nM | Fold change to WT CD80 | MFI at 33.3 nM | Fold change to WT CD80 | MFI at 33.3 nM | Fold change to WT CD80 | Ratio of PDL1: CD28 |
| T13R/Q33R/E35D/M47L/V68M/L85M | 2809 | 13438 | 7.7 | 112 | 3.6 | 18938 | 367.7 | 169.1 |
| V22D/E24D/E35D/M47L/V68M | 2810 | 19403 | 11.1 | 1254 | 39.9 | 15418 | 299.4 | 12.3 |
| V22D/E24D/E35D/M47L/V68M/L85M/D90G | 2811 | 14574 | 8.3 | 1183 | 37.7 | 19047 | 369.8 | 16.1 |
| V22D/E24D/E35D/M47V/V68M | 2812 | 16899 | 9.6 | 191 | 6.1 | 17793 | 345.5 | 93.2 |
| WT CD80 ECD-Fc | 2 | 1753 | 1.0 | 31 | 1.0 | 52 | 1.0 | 1.6 |
| CD80 WT IgV-Fc | 3031 | 26392 | 15.1 | 95 | 3.0 | 44 | 0.9 | 0.5 |

2. Bioactivity Assessment

TABLE 22

Jurkat/IL2 + CHO/OKT3/PD-L1 Reporter Assay: Relative Luciferase Units (RLU)

| CD80 Mutation(s) | SEQ ID NO: | CD80 Conc 5.0 nM | Fold Increase over WT CD80-IgV-Fc |
|---|---|---|---|
| E35D/N48K/L72V | 2719 | 1731 | 4.3 |
| E35D/T41S/N48T | 2720 | 1136 | 2.8 |
| D46V/M47I/A71G | 2721 | 1601 | 4.0 |
| M47I/A71G | 2722 | 1762 | 4.4 |
| E35D/M43I/M47L/L85M | 2723 | 1427 | 3.6 |
| E35D/M43I/D46E/A71G/L85M | 2724 | 1475 | 3.7 |
| H18Y/E35D/M47L/A71G/A91S | 2725 | 1898 | 4.7 |
| E35D/M47I/N48K/I61F | 2726 | 2078 | 5.2 |
| E35D/M47V/T62S/L85Q | 2727 | 1402 | 3.5 |
| M43I/M47L/A71G | 2728 | 1641 | 4.1 |
| E35D/M47V | 2729 | 1353 | 3.4 |
| E35D/M47L/A71G/L85M | 2730 | 1513 | 3.8 |
| V22A/E35D/M47L/A71G | 2731 | 2583 | 6.5 |
| E35D/M47L/A71G | 2732 | 1954 | 4.9 |

TABLE 22-continued

Jurkat/IL2 + CHO/OKT3/PD-L1 Reporter Assay: Relative Luciferase Units (RLU)

| CD80 Mutation(s) | SEQ ID NO: | CD80 Conc 5.0 nM | Fold Increase over WT CD80-IgV-Fc |
|---|---|---|---|
| E35D/D46E/M47I | 2733 | 1915 | 4.8 |
| Q27H/E35D/M47I | 2734 | 1829 | 4.6 |
| E35D/D46E/L85M | 2735 | 1413 | 3.5 |
| E35D/D46E/A91G | 2736 | 395 | 1.0 |
| E35D/D46E | 2737 | 1961 | 4.9 |
| E35D/L97R | 2738 | 914 | 2.3 |
| H18Y/E35D | 2739 | 1990 | 5.0 |
| Q27L/E35D/M47V/I61V/L85M | 2740 | 1166 | 2.9 |
| E35D/M47V/I61V/L85M | 2741 | 1176 | 2.9 |
| E35D/M47V/L85M/R94Q | 2742 | 466 | 1.2 |
| E35D/M47V/N48K/L85M | 2743 | 2116 | 5.3 |
| H18Y/E35D/M47V/N48K | 2744 | 2146 | 5.4 |
| CD80 WT IgV-Fc | 3031 | 400 | 1.0 |
| CD80 ECD-Fc | 2 | 521 | 1.3 |

TABLE 23

Jurkat/IL2 + CHO/OKT3/PD-L1 Reporter Assay: Relative Luciferase Units (RLU)

| CD80 Mutation(s) | SEQ ID NO (IgV) | CD80 Conc 5.0 nM | Fold Increase over WT CD80-IgV-Fc |
|---|---|---|---|
| E24D/E35D/M47L/V68M/E95V/L97Q | 2765 | 1087 | 2.7 |
| E35D/D46E/M47I/T62A/V68M/L85M/Y87C | 2766 | 1104 | 2.8 |
| E35D/D46E/M47I/V68M/L85M | 2767 | 1230 | 3.1 |
| E35D/D46E/M47L/V68M/A71G/Y87C/K93R | 2768 | 1198 | 3.0 |
| E35D/D46E/M47L/V68M/T79M/L85M | 2769 | 1137 | 2.8 |
| E35D/D46E/M47L/V68M/T79M/L85M/L97Q | 2770 | 160 | 0.4 |
| E35D/D46E/M47V/V68M/L85Q | 2771 | 1006 | 2.5 |
| E35D/M43I/M47L/V68M | 2772 | 1072 | 2.7 |
| E35D/M47I/V68M/Y87N | 2773 | 958 | 2.4 |
| E35D/M47L/V68M/E95V/L97Q | 2774 | 1086 | 2.7 |
| E35D/M47L/Y53F/V68M/A71G/K93R/E95V | 2775 | 1546 | 3.9 |
| E35D/M47V/N48K/V68M/A71G/L85M | 2776 | 1422 | 3.6 |
| E35D/M47V/N48K/V68M/L85M | 2777 | 1203 | 3.0 |
| E35D/M47V/V68M/L85M | 2778 | 1167 | 2.9 |
| E35D/M47V/V68M/L85M/Y87D | 2779 | 1181 | 3.0 |
| E35D/T41S/D46E/M47I/V68M/K93R/E95V | 2780 | 1165 | 2.9 |
| H18Y/E35D/D46E/M47I/V68M/R94L | 2781 | 1425 | 3.6 |
| H18Y/E35D/M38I/M47L/V68M/L85M | 2782 | 198 | 0.5 |
| H18Y/E35D/M47I/V68M/Y87N | 2783 | 1117 | 2.8 |
| H18Y/E35D/M47L/V68M/A71G/L85M | 2784 | 1219 | 3.0 |
| H18Y/E35D/M47L/V68M/E95V/L97Q | 2785 | 225 | 0.6 |
| H18Y/E35D/M47L/Y53F/V68M/A71G | 2786 | 120 | 0.3 |
| H18Y/E35D/M47L/Y53F/V68M/A71G/K93R/E95V | 2787 | 1190 | 3.0 |
| H18Y/E35D/M47V/V68M/L85M | 2788 | 1013 | 2.5 |

TABLE 23-continued

| Jurkat/IL2 + CHO/OKT3/PD-L1 Reporter Assay: Relative Luciferase Units (RLU) | | | |
|---|---|---|---|
| CD80 Mutation(s) | SEQ ID NO (IgV) | CD80 Conc 5.0 nM | Fold Increase over WT CD80-IgV-Fc |
| H18Y/E35D/V68M/A71G/R94Q/E95V | 2789 | 183 | 0.5 |
| H18Y/E35D/V68M/L85M/R94Q | 2790 | 195 | 0.5 |
| H18Y/E35D/V68M/T79M/L85M | 2791 | 1161 | 2.9 |
| H18Y/V22D/E35D/M47V/N48K/V68M | 2792 | 1072 | 2.7 |
| Q27L/Q33L/E35D/T41S/M47V/N48K/V68M/L85M | 2793 | 170 | 0.4 |
| Q33L/E35D/M47V/T62S/V68M/L85M | 2794 | 158 | 0.4 |
| Q33R/E35D/M38I/M47L/V68M | 2795 | 147 | 0.4 |
| R29C/E35D/M47L/V68M/A71G/L85M | 2796 | 155 | 0.4 |
| S21P/E35D/K37E/D46E/M47I/V68M | 2797 | 1064 | 2.7 |
| S21P/E35D/K37E/D46E/M47I/V68M/R94L | 2798 | 1205 | 3.0 |
| T13R/E35D/M47L/V68M | 2799 | 1021 | 2.6 |
| T13R/Q27L/Q33L/E35D/T41S/M47V/N48K/V68M/L85M | 2801 | 170 | 0.4 |
| T13R/Q33L/E35D/M47L/V68M/L85M | 2802 | 153 | 0.4 |
| T13R/Q33L/E35D/M47V/T62S/V68M/L85M | 2803 | 136 | 0.3 |
| T13R/Q33R/E35D/M38I/M47L/V68M | 2804 | 152 | 0.4 |
| T13R/Q33R/E35D/M38I/M47L/V68M/E95V/L97Q | 2805 | 993 | 2.5 |
| T13R/Q33R/E35D/M38I/M47L/V68M/L85M | 2806 | 153 | 0.4 |
| T13R/Q33R/E35D/M38I/M47L/V68M/L85M/R94Q | 2807 | 580 | 1.5 |
| T13R/Q33R/E35D/M47L/V68M | 2808 | 399 | 1.0 |
| T13R/Q33R/E35D/M47L/V68M/L85M | 2809 | 1160 | 2.9 |
| V22D/E24D/E35D/M47L/V68M | 2810 | 974 | 2.4 |
| V22D/E24D/E35D/M47L/V68M/L85M/D90G | 2811 | 963 | 2.4 |
| V22D/E24D/E35D/M47V/V68M | 2812 | 1023 | 2.6 |
| CD80 WT IgV-Fc | 3031 | 400 | 1.0 |
| WT CD80 ECD-Fc H22.6 | 2 | 521 | 1.3 |

B. Generation of Variant CD80 IgV Binding Domains and High-Throughput Selection

Additional CD80 IgV variants were selected after generating 300 CD8 IgV-Fc constructs from the yeast outputs described in Example 7. Supernatants containing the CD80 IgV-Fc proteins were then screened for PD-L1 binding in a96-well plate format using an Octet® System. Variants that exhibited high PD-L1 binding were selected and rescreened for binding as described in Example 7 above, and variants were selected that exhibited high PD-L1 binding. Exemplary variants and the FACS binding data are provided in Table 24. The selected variants also were assessed for bioactivity using the methods substantially as described in Example 9, and the results are shown in Table 25.

TABLE 24

| Flow Binding to Jurkats (CD28) and CHO cells stably expressing CTLA4 or PD-L1 | | | | | | | | |
|---|---|---|---|---|---|---|---|---|
| | | CTLA4 | | CD28 | | PD-L1 | | |
| CD80 Mutation(s) | SEQ ID NO (IgV) | MFI at 33.3 nM | Fold change to WT CD80 | MFI at 33.3 nM | Fold change to WT | MFI at 33.3 nM | Fold change to WT | Ratio of PDL1: CD28 |
| A26E/Q27R/E35D/M47L/N48Y/L85Q | 2323 | 10848 | 10.6 | 78 | 1.9 | 9315 | 111.7 | 119 |
| E35D/D46E/M47L/V68M/L85Q/F92L | 2324 | 214 | 0.2 | 15 | 0.4 | 13200 | 158.3 | 863 |
| E35D/M47I/T62S/L85Q/E88D | 2325 | 8913 | 8.7 | 111 | 2.7 | 8417 | 100.9 | 76 |
| E24D/Q27R/E35D/T41S M47V/L85Q | 2326 | 13867 | 13.5 | 66 | 1.6 | 2858 | 34.3 | 44 |
| S15T/H18Y/E35D/M47V/T62A/N64S/ A71G/L85Q/D90N | 2327 | 10994 | 10.7 | 1068 | 25.9 | 13883 | 166.5 | 13 |
| E35D/M47L/V68M/A71G/L85Q/D90G | 2328 | 10332 | 10.1 | 1400 | 33.9 | 16832 | 201.8 | 12 |
| H18Y/E35D/M47I/V68M/A71G/R94L | 2329 | 10036 | 9.8 | 1905 | 46.1 | 14487 | 173.7 | 8 |
| deltaE10-A98 | 2330 | 125 | 0.1 | 15 | 0.4 | 45 | 0.5 | 3 |
| Q33R/M47V/T62N/A71G | 2331 | 308 | 0.3 | 17 | 0.4 | 12216 | 146.5 | 719 |
| H18Y/V22A/E35D/T41S/M47V/T62N/ A71G/A91G | 2332 | 10290 | 10.0 | 1591 | 38.5 | 8459 | 101.4 | 5 |
| CD 80 WT IgV-Fc | 3031 | 1026 | 1.0 | 41 | 1.0 | 83 | 1.0 | 2 |
| CD 80 ECD-Fc | 2 | 31725 | 30.9 | 30 | 0.7 | 68 | 0.8 | 2 |

TABLE 25

| Jurkat/IL2 + CHO/OKT3/PD-L1 Reporter Assay: Relative Luciferase Units (RLU) | | | |
|---|---|---|---|
| CD80 Mutations | SEQ ID NO (IgV) | CD80-FC Conc 5.0 nM | Fold Increase over WT CD80-IgV-Fc |
| A26E/Q27R/E35D/M47L/N48Y/L85Q | 2323 | 433 | 1.1 |
| E35D/D46E/M47L/V68M/L85Q/F92L | 2324 | 2551 | 6.4 |
| E35D/M47I/T62S/L85Q/E88D | 2325 | 605 | 1.5 |
| E24D/Q27R/E35D/T41S/M47V/L85Q | 2326 | 147 | 0.4 |
| S15T/H18Y/E35D/M47V/T62A/N64S/A71G/L85Q/D90N | 2327 | 872 | 2.2 |
| E35D/M47L/V68M/A71G/L85Q/D90G | 2328 | 936 | 2.3 |
| H18Y/E35D/M47I/V68M/A71G/R94L | 2329 | 879 | 2.2 |
| deltaE10-A98 | 2330 | 137 | 0.3 |
| Q33R/M47V/T62N/A71G | 2331 | 149 | 0.4 |
| H18Y/V22A/E35D/T41S/M47V/T62N/A71G/A91G | 2332 | 1045 | 2.6 |
| CD80 WT IgV-Fc | 3031 | 400 | 1.0 |
| CD80 ECD-Fc | 2 | 521 | 1.3 |

C. Generation of CD80 IgV Consensus Variants

Consensus variants of CD80 IgV variants were designed based on the alignments of outputs from all of the yeast selections described above. The consensus sequences were then used to generate CD80 IgV-Fc proteins that were then tested for binding and bioactivity as described above. The binding and bioactivity results are provided in Tables 26 and 27, respectively.

TABLE 26

| Flow Binding to Jurkats (CD28) and CHO cells stably expressing CTLA4 or PD-L1 | | | | | | | | |
|---|---|---|---|---|---|---|---|---|
| | | CTLA4 | | CD28 | | PD-L1 | | |
| CD80 Mutations | SEQ ID NO (IgV) | MFI at 33.3 nM | Fold change to WT CD80 | MFI at 33.3 nM | Fold change to WT | MFI at 33.3 nM | Fold change to WT | Ratio of PDL1: CD28 |
| H18Y/E35D/D46E/M47I/V68M/R94L | 2781 | 19236 | 18.4 | 1006 | 24.4 | 2082 | 29.4 | 2.1 |
| H18Y/E35D/M47I/V68M/Y87N | 2783 | 19722 | 18.9 | 1429 | 34.7 | 9299 | 131.2 | 6.5 |
| H18Y/E35D/M47L/V68M/A71G/L85M | 2784 | 20660 | 19.8 | 2848 | 69.1 | 9894 | 139.5 | 3.5 |
| H18Y/E35D/M47L/V68M/E95V/L97Q | 2785 | 18022 | 17.2 | 2602 | 63.2 | 9629 | 135.8 | 3.7 |
| H18Y/E35D/M47L/Y53F/V68M/A71G | 2786 | 19528 | 18.7 | 478 | 11.6 | 9576 | 135.1 | 20.0 |
| H18Y/E35D/M47L/Y53F/ V68M/A71G/K93R/E95V | 2787 | 19754 | 18.9 | 2194 | 53.3 | 9339 | 131.7 | 4.3 |
| H18Y/E35D/M47V/V68M/L85M | 2788 | 19306 | 18.5 | 1387 | 33.7 | 3094 | 43.6 | 2.2 |
| H18Y/E35D/V68M/A71G/R94Q/E95V | 2789 | 19396 | 18.6 | 455 | 11.0 | 1836 | 25.9 | 4.0 |
| H18Y/E35D/V68M/L85M/R94Q | 2790 | 21955 | 21.0 | 962 | 23.3 | 9283 | 130.9 | 9.6 |
| CD80 WT IgV-Fc | 3031 | 1045 | 1.0 | 41.2 | 1.0 | 70.9 | 1.0 | 1.7 |
| CD80 ECD-Fc | 2 | 46137 | 44.2 | 46 | 1.1 | 58 | 0.8 | 1.3 |

TABLE 27

| Jurkat/IL2 + CHO/OKT3/PD-L1 Reporter Assay: Relative Luciferase Units (RLU) | | | |
|---|---|---|---|
| CD80 Mutations | SEQ ID NO: | CD80 Conc 5.0 nM | Fold Increase over WT CD80-IgV-Fc |
| H18Y/E35D/D46E/M47I/V68M/R94L | 2781 | 2850 | 7.1 |
| H18Y/E35D/M47I/V68M/Y87N | 2783 | 2196 | 5.5 |
| H18Y/E35D/M47L/V68M/A71G/L85M | 2784 | 2193 | 5.5 |
| H18Y/E35D/M47L/V68M/E95V/L97Q | 2785 | 2052 | 5.1 |
| H18Y/E35D/M47L/Y53F/V68M/A71G | 2786 | 2277 | 5.7 |
| H18Y/E35D/M47L/Y53F/V68M/A71G/K93R/E95V | 2787 | 2212 | 5.5 |
| H18Y/E35D/M47V/V68M/L85M | 2788 | 2575 | 6.4 |
| H18Y/E35D/V68M/A71G/R94Q/E95V | 2789 | 1968 | 4.9 |
| H18Y/E35D/V68M/L85M/R94Q | 2790 | 2215 | 5.5 |
| CD80 WT IgV-Fc | 3031 | 400 | 1.0 |
| CD80 ECD-Fc | 2 | 521 | 1.3 |

Example 14

Assessment of Binding Activity of a Panel of CD80 IgV Variants

To identify residues involved in binding and activity with reference to a selected set of variants set forth in SEQ ID NOs: 2250, 2276, and 2280, a panel of reversion (back) mutations were designed and expressed as Fc fusion proteins substantially as described in Examples 4 and 5. The variants generated contained between 1 and 6 mutations found in SEQ ID NOS: 2250, 2276 and 2280 in various combinations as set forth in Table 28.

TABLE 28

Additional CD80 Variants

| Mutation | SEQ ID NO: |
|---|---|
| E35D | 198 |
| D46V | 2813 |
| M47L | 2814 |
| V68M | 2815 |
| L85Q | 2816 |
| E35D/D46V | 2817 |
| E35D/M47L | 208 |
| E35D/L85Q | 2819 |
| D46V/M47L | 2820 |
| D46V/V68M | 2821 |
| D46V/L85Q | 2822 |
| M47L/V68M | 2823 |
| M47L/L85Q | 2824 |
| V68M/L85Q | 2825 |
| E35D/D46V/M47L | 2826 |
| E35D/D46V/V68M | 2827 |
| E35D/D46V/L85Q | 2828 |
| E35D/M47L/V68M | 2756 |
| E35D/M47L/L85Q | 2203 |
| E35D/V68M/L85Q | 2829 |
| D46V/M47L/V68M | 2830 |
| D46V/M47L/L85Q | 2831 |
| D46V/V68M/L85Q | 2832 |
| M47L/V68M/L85Q | 2833 |
| E35D/D46V/M47L/V68M | 2761 |
| E35D/D46V/M47L/L85Q | 2834 |
| E35D/D46V/V68M/L85Q | 2835 |
| E35D/M47L/V68M/L85Q | 2836 |
| D46V/M47L/V68M/L85Q | 2837 |
| E35D/D46V/M47L/V68M/L85Q | 2760 |
| M47V | 2838 |
| N48K | 2839 |
| K89N | 2840 |
| E35D/M47V | 2729 |
| E35D/N48K | 2841 |
| E35D/K89N | 2842 |
| M47V/N48K | 2843 |
| M47V/V68M | 2844 |
| M47V/K89N | 2845 |
| N48K/V68M | 2846 |
| N48K/K89N | 2847 |
| V68M/K89N | 2848 |
| E35D/M47V/N48K | 2849 |
| E35D/M47V/V68M | 2850 |
| E35D/M47V/K89N | 2851 |
| E35D/N48K/V68M | 2852 |
| E35D/N48K/K89N | 2853 |
| E35D/V68M/K89N | 2854 |
| M47V/N48K/V68M | 2855 |
| M47V/N48K/K89N | 2856 |
| M47V/V68M/K89N | 2857 |
| N48K/V68M/K89N | 2858 |
| E35D/M47V/N48K/V68M | 2764 |
| E35D/M47V/N48K/K89N | 2859 |
| E35D/M47V/V68M/K89N | 2860 |
| E35D/N48K/V68M/K89N | 2861 |
| M47V/N48K/V68M/K89N | 2862 |
| E35D/D46V/M47V/N48K/V68M | 2863 |
| E35D/D46V/M47V/V68M/L85Q | 2864 |
| E35D/D46V/M47V/V68M/K89N | 2865 |
| E35D/M47V/N48K/V68M/L85Q | 2866 |
| E35D/M47V/N48K/V68M/K89N | 2250 |
| E35D/M47V/V68M/L85Q/K89N | 2867 |
| A26E/E35D/M47L/V68M/A71G/D90G | 2868 |
| H18Y/E35D/M47L/V68M/A71G/D90G | 2869 |
| H18Y/A26E/M47L/V68M/A71G/D90G | 2870 |
| H18Y/A26E/E35D/V68M/A71G/D90G | 2871 |
| H18Y/A26E/E35D/M47L/A71G/D90G | 2872 |
| H18Y/A26E/E35D/M47L/V68M/D90G | 2873 |
| H18Y/A26E/E35D/M47L/V68M/A71G | 2874 |
| E35D/M47L/V68M/A71G/D90G | 2875 |
| H18Y/M47L/V68M/A71G/D90G | 2876 |
| H18Y/A26E/V68M/A71G/D90G | 2877 |
| H18Y/A26E/E35D/A71G/D90G | 2878 |
| H18Y/A26E/E35D/M47L/D90G | 2879 |
| H18Y/A26E/E35D/M47L/V68M | 2880 |
| A26E/M47L/V68M/A71G/D90G | 2881 |
| A26E/E35D/V68M/A71G/D90G | 2882 |
| A26E/E35D/M47L/A71G/D90G | 2883 |
| A26E/E35D/M47L/V68M/D90G | 2884 |
| A26E/E35D/M47L/V68M/A71G | 2885 |
| H18Y/E35D/V68M/A71G/D90G | 2886 |
| H18Y/E35D/M47L/A71G/D90G | 2887 |
| H18Y/E35D/M47L/V68M/D90G | 2888 |
| H18Y/E35D/M47L/V68M/A71G | 2889 |
| H18Y/A26E/M47L/A71G/D90G | 2890 |
| H18Y/A26E/M47L/V68M/D90G | 2891 |
| H18Y/A26E/M47L/V68M/A71G | 2892 |
| H18Y/A26E/E35D/V68M/D90G | 2893 |
| H18Y/A26E/E35D/V68M/A71G | 2894 |
| H18Y/A26E/E35D/M47L/A71G | 2895 |
| M47L/V68M/A71G/D90G | 2896 |
| H18Y/V68M/A71G/D90G | 2897 |
| H18Y/A26E/A71G/D90G | 2898 |
| H18Y/A26E/E35D/D90G | 2899 |
| H18Y/A26E/E35D/M47L | 2900 |
| E35D/V68M/A71G/D90G | 2901 |
| E35D/M47L/A71G/D90G | 2902 |
| E35D/M47L/V68M/D90G | 2903 |
| E35D/M47L/V68M/A71G | 2904 |
| A26E/V68M/A71G/D90G | 2905 |
| A26E/M47L/A71G/D90G | 2906 |
| A26E/M47L/V68M/D90G | 2907 |
| A26E/M47L/V68M/A71G | 2908 |
| A26E/E35D/V68M/D90G | 2910 |
| A26E/E35D/V68M/A71G | 2911 |
| A26E/E35D/M47L/D90G | 2912 |
| A26E/E35D/M47L/A71G | 2913 |
| H18Y/M47L/A71G/D90G | 2914 |
| H18Y/M47L/V68M/D90G | 2915 |
| H18Y/M47L/V68M/A71G | 2916 |
| H18Y/E35D/A71G/D90G | 2917 |
| H18Y/E35D/M47L/A71G | 2921 |
| H18Y/A26E/V68M/D90G | 2923 |
| H18Y/A26E/V68M/A71G | 2924 |
| H18Y/A26E/M47L/D90G | 2925 |
| H18Y/A26E/M47L/A71G | 2926 |
| H18Y/A26E/E35D/V68M | 2929 |

The variants were tested for binding and bioactivity as described above. The binding results are set forth in Tables 29 and 30, and the bioactivity results are set forth in Tables 31 and 32.

TABLE 29

Flow Binding to Jurkats (CD28) and CHO cells stably expressing CTLA4 or PD-L1

| Mutation(s) | SEQ ID NO (IgV) | CTLA4 MFI at 33.3 nM | CTLA4 Fold change to WT CD80 | CD28 MFI at 33.3 nM | CD28 Fold change to WT CD80 | PD-L1 MFI at 33.3 nM | PD-L1 Fold change to WT CD80 | Ratio of PDL1: CD28 |
|---|---|---|---|---|---|---|---|---|
| E35D | 198 | 42923 | 1.1 | 134 | 0.2 | 2584 | 20.2 | 19.3 |
| M47L | 2814 | 30774 | 0.8 | 309 | 0.4 | 1895 | 14.8 | 6.1 |
| V68M | 2815 | 568 | 0.0 | 37.9 | 0.1 | 118 | 0.9 | 3.1 |
| L85Q | 2816 | 3002 | 0.1 | 35 | 0.0 | 97 | 0.8 | 2.8 |
| E35D/D46V | 2817 | 50112 | 1.2 | 880 | 1.2 | 3971 | 31.0 | 4.5 |
| E35D/M47L | 208 | 48010 | 1.2 | 411 | 0.6 | 7529 | 58.8 | 18.3 |
| D46V/M47L | 2820 | 49711 | 1.2 | 918 | 1.3 | 3905 | 30.5 | 4.3 |
| D46V/V68M | 2821 | 5334 | 0.1 | 556 | 0.8 | 2271 | 17.7 | 4.1 |
| D46V/L85Q | 2822 | 41896 | 1.0 | 131 | 0.2 | 2197 | 17.2 | 16.8 |
| M47L/L85Q | 2824 | 31671 | 0.8 | 88.1 | 0.1 | 5801 | 45.3 | 65.8 |
| V68M/L85Q | 2825 | 3288 | 0.1 | 91.7 | 0.1 | 347 | 2.7 | 3.8 |
| E35D/D46V/M47L | 2826 | 44977 | 1.1 | 1165 | 1.6 | 7988 | 62.4 | 6.9 |
| E35D/D46V/V68M | 2827 | 31195 | 0.8 | 1820 | 2.6 | 26114 | 204.0 | 14.3 |
| E35D/D46V/L85Q | 2828 | 48005 | 1.2 | 196 | 0.3 | 4039 | 31.6 | 20.6 |
| E35D/M47L/V68M | 2756 | 28603 | 0.7 | 1243 | 1.8 | 27896 | 217.9 | 22.4 |
| E35D/M47L/L85Q | 2203 | 12909 | 0.3 | 46.3 | 0.1 | 6097 | 47.6 | 131.7 |
| E35D/V68M/L85Q | 2829 | 42761 | 1.1 | 76.2 | 0.1 | 5971 | 46.6 | 78.4 |
| D46V/M47L/V68M | 2830 | 34688 | 0.9 | 2183 | 3.1 | 28020 | 218.9 | 12.8 |
| D46V/M47L/L85Q | 2831 | 40153 | 1.0 | 567 | 0.8 | 5976 | 46.7 | 10.5 |
| D46V/V68M/L85Q | 2832 | 7567 | 0.2 | 104 | 0.1 | 4170 | 32.6 | 40.1 |
| M47L/V68M/L85Q | 2833 | 11134 | 0.3 | 60.9 | 0.1 | 4039 | 31.6 | 66.3 |
| E35D/D46V/M47L/V68M | 2761 | 34319 | 0.8 | 1808 | 2.6 | 29266 | 228.6 | 16.2 |
| E35D/D46V/M47L/L85Q | 2834 | 38150 | 0.9 | 268 | 0.4 | 7523 | 58.8 | 28.1 |
| E35D/D46V/V68M/L85Q | 2835 | 32176 | 0.8 | 261 | 0.4 | 23637 | 184.7 | 90.6 |
| E35D/M47L/V68M/L85Q | 2836 | 28106 | 0.7 | 159 | 0.2 | 15307 | 119.6 | 96.3 |
| D46V/M47L/V68M/L85Q | 2837 | 32521 | 0.8 | 660 | 0.9 | 29743 | 232.4 | 45.1 |
| E35D/D46V/M47L/V68M/L85Q | 2760 | 26207 | 0.6 | 464 | 0.7 | 28418 | 222.0 | 61.2 |
| M47V | 2838 | 33341 | 0.8 | 68.7 | 0.1 | 2317 | 18.1 | 33.7 |
| N48K | 2839 | 4952 | 0.1 | 60.1 | 0.1 | 481 | 3.8 | 8.0 |
| K89N | 2840 | 944 | 0.0 | 56.3 | 0.1 | 52.8 | 0.4 | 0.9 |
| E35D/M47V | 2729 | 44569 | 1.1 | 501 | 0.7 | 6796 | 53.1 | 13.6 |
| E35D/N48K | 2841 | 41325 | 1.0 | 194 | 0.3 | 6545 | 51.1 | 33.7 |
| E35D/K89N | 2842 | 21755 | 0.5 | 236 | 0.3 | 757 | 5.9 | 3.2 |
| M47V/N48K | 2843 | 44640 | 1.1 | 413 | 0.6 | 3083 | 24.1 | 7.5 |
| M47V/V68M | 2844 | 7282 | 0.2 | 328 | 0.5 | 4294 | 33.5 | 13.1 |
| M47V/K89N | 2845 | 32381 | 0.8 | 197 | 0.3 | 622 | 4.9 | 3.2 |
| N48K/V68M | 2846 | 2341 | 0.1 | 118 | 0.2 | 754 | 5.9 | 6.4 |
| N48K/K89N | 2847 | 4370 | 0.1 | 170 | 0.2 | 186 | 1.5 | 1.1 |
| V68M/K89N | 2848 | 2330 | 0.1 | 210 | 0.3 | 538 | 4.2 | 2.6 |
| E35D/M47V/N48K | 2849 | 47430 | 1.2 | 771 | 1.1 | 4852 | 37.9 | 6.3 |
| E35D/M47V/V68M | 2850 | 26988 | 0.7 | 791 | 1.1 | 16645 | 130.0 | 21.0 |
| E35D/M47V/K89N | 2851 | 39282 | 1.0 | 507 | 0.7 | 4336 | 33.9 | 8.6 |
| E35D/N48K/V68M | 2852 | 33583 | 0.8 | 642 | 0.9 | 17733 | 138.5 | 27.6 |
| E35D/N48K/K89N | 2853 | 34727 | 0.9 | 411 | 0.6 | 5766 | 45.0 | 14.0 |
| E35D/V68M/K89N | 2854 | 24838 | 0.6 | 1191 | 1.7 | 10422 | 81.4 | 8.8 |
| M47V/N48K/V68M | 2855 | 34612 | 0.9 | 641 | 0.9 | 14464 | 113.0 | 22.6 |
| M47V/N48K/K89N | 2856 | 42071 | 1.0 | 366 | 0.5 | 2366 | 18.5 | 6.5 |
| M47V/V68M/K89N | 2857 | 24787 | 0.6 | 1324 | 1.9 | 11806 | 92.2 | 8.9 |
| N48K/V68M/K89N | 2858 | 19129 | 0.5 | 1176 | 1.7 | 11464 | 89.6 | 9.7 |
| E35D/M47V/N48K/V68M | 2764 | 32913 | 0.8 | 789 | 1.1 | 23479 | 183.4 | 29.8 |
| E35D/M47V/N48K/K89N | 2859 | 43756 | 1.1 | 701 | 1.0 | 6669 | 52.1 | 9.5 |
| E35D/M47V/V68M/K89N | 2860 | 29493 | 0.7 | 1610 | 2.3 | 21827 | 170.5 | 13.6 |
| E35D/N48K/V68M/K89N | 2861 | 29772 | 0.7 | 1534 | 2.2 | 17425 | 136.1 | 11.4 |
| M47V/N48K/V68M/K89N | 2862 | 29777 | 0.7 | 1597 | 2.3 | 23666 | 184.9 | 14.8 |
| E35D/D46V/M47V/N48K/V68M | 2863 | 23880 | 0.6 | 1085 | 1.5 | 25940 | 202.7 | 23.9 |
| E35D/D46V/M47V/V68M/L85Q | 2864 | 36463 | 0.9 | 331 | 0.5 | 26290 | 205.4 | 79.4 |
| E35D/D46V/M47V/V68M/K89N | 2865 | 15124 | 0.4 | 2119 | 3.0 | 21603 | 168.8 | 10.2 |
| E35D/M47V/N48K/V68M/L85Q | 2866 | 26104 | 0.6 | 118 | 0.2 | 10479 | 81.9 | 88.8 |
| E35D/M47V/N48K/V68M/K89N | 2250 | 20884 | 0.5 | 1348 | 1.9 | 14800 | 115.6 | 11.0 |
| E35D/M47V/V68M/L85Q/K89N | 2867 | 30276 | 0.7 | 246 | 0.3 | 12085 | 94.4 | 49.1 |
| WT CD80 ECD-Fc (Abcam) | | 40376 | 1.0 | 709 | 1.0 | 128 | 1.0 | 0.2 |
| Fc1.1 Control N10118 | 1714 | 52 | 0.0 | 12.7 | 0.0 | 44 | 0.3 | 3.5 |

TABLE 30

Flow Binding to Jurkats (CD28) and CHO cells stably expressing CTLA4 or PD-L1

| | | CTLA4 | | CD28 | | PD-L1 | | |
|---|---|---|---|---|---|---|---|---|
| Mutation(s) | SEQ ID NO | MFI at 33.3 nM | Fold change to WT CD80 | MFI at 33.3 nM | Fold change to WT CD80 | MFI at 33.3 nM | Fold change to WT CD80 | Ratio of PDL1: CD28 |
| A26E/E35D/M47L/V68M/A71G/D90G | 2868 | 21749 | 16.0 | 2211 | 50.4 | 30232 | 693.4 | 13.7 |
| H18Y/E35D/M47L/V68M/A71G/D90G | 2869 | 19892 | 14.6 | 2793 | 63.6 | 29944 | 686.8 | 10.7 |
| H18Y/A26E/M47L/V68M/A71G/D90G | 2870 | 121 | 0.1 | 2556 | 58.2 | 31716 | 727.4 | 12.4 |
| H18Y/A26E/E35D/V68M/A71G/D90G | 2871 | 23386 | 17.2 | 1757 | 40.0 | 28683 | 657.9 | 16.3 |
| H18Y/A26E/E35D/M47L/A71G/D90G | 2872 | 21215 | 15.6 | 1099 | 25.0 | 16926 | 388.2 | 15.4 |
| H18Y/A26E/E35D/M47L/V68M/D90G | 2873 | 24855 | 18.3 | 2675 | 60.9 | 25217 | 578.4 | 9.4 |
| H18Y/A26E/E35D/M47L/V68M/A71G | 2874 | 25404 | 18.7 | 526 | 12.0 | 28546 | 654.7 | 54.3 |
| E35D/M47L/V68M/A71G/D90G | 2875 | 26007 | 19.1 | 3072 | 70.0 | 29377 | 673.8 | 9.6 |
| H18Y/M47L/V68M/A71G/D90G | 2876 | 22235 | 16.4 | 3184 | 72.5 | 29517 | 677.0 | 9.3 |
| H18Y/A26E/V68M/A71G/D90G | 2877 | 18305 | 13.5 | 2683 | 61.1 | 27872 | 639.3 | 10.4 |
| H18Y/A26E/E35D/A71G/D90G | 2878 | −100 | −0.1 | 1075 | 24.5 | 14822 | 340.0 | 13.8 |
| H18Y/A26E/E35D/M47L/D90G | 2879 | 19736 | 14.5 | 1379 | 31.4 | 12698 | 291.2 | 9.2 |
| H18Y/A26E/E35D/M47L/V68M | 2880 | 20015 | 14.7 | 626 | 14.3 | 24683 | 566.1 | 39.4 |
| A26E/M47L/V68M/A71G/D90G | 2881 | 21807 | 16.0 | 2790 | 63.6 | 28139 | 645.4 | 10.1 |
| A26E/E35D/V68M/A71G/D90G | 2882 | 23286 | 17.1 | 2102 | 47.9 | 26510 | 608.0 | 12.6 |
| A26E/E35D/M47L/A71G/D90G | 2883 | 22127 | 16.3 | 1272 | 29.0 | 14550 | 333.7 | 11.4 |
| A26E/E35D/M47L/V68M/D90G | 2884 | 26698 | 19.6 | 2908 | 66.2 | 24978 | 572.9 | 8.6 |
| A26E/E35D/M47L/V68M/A71G | 2885 | 24587 | 18.1 | 417 | 9.5 | 27806 | 637.8 | 66.7 |
| H18Y/E35D/V68M/A71G/D90G | 2886 | 24335 | 17.9 | 2724 | 62.1 | 30088 | 690.1 | 11.0 |
| H18Y/E35D/M47L/A71G/D90G | 2887 | 22983 | 16.9 | 1273 | 29.0 | 13327 | 305.7 | 10.5 |
| H18Y/E35D/M47L/V68M/D90G | 2888 | 22834 | 16.8 | 3389 | 77.2 | 27410 | 628.7 | 8.1 |
| H18Y/E35D/M47L/V68M/A71G | 2889 | 23667 | 17.4 | 928 | 21.1 | 30377 | 696.7 | 32.7 |
| H18Y/A26E/M47L/A71G/D90G | 2890 | 25420 | 18.7 | 2047 | 46.6 | 17737 | 406.8 | 8.7 |
| H18Y/A26E/M47L/V68M/D90G | 2891 | 28649 | 21.1 | 32 | 0.7 | 23594 | 541.1 | 737.3 |
| H18Y/A26E/M47L/V68M/A71G | 2892 | 21742 | 16.0 | 544 | 12.4 | 29730 | 681.9 | 54.7 |
| H18Y/A26E/E35D/V68M/D90G | 2893 | 19331 | 14.2 | 2584 | 58.9 | 23206 | 532.2 | 9.0 |
| H18Y/A26E/E35D/V68M/A71G | 2894 | 19394 | 14.3 | 394 | 9.0 | 27476 | 630.2 | 69.7 |
| H18Y/A26E/E35D/M47L/A71G | 2895 | 19353 | 14.2 | 379 | 8.6 | 16887 | 387.3 | 44.6 |
| M47L/V68M/A71G/D90G | 2896 | 17418 | 12.8 | 3610 | 82.2 | 31114 | 713.6 | 8.6 |
| H18Y/V68M/A71G/D90G | 2897 | 22321 | 16.4 | 3414 | 77.8 | 30670 | 703.4 | 9.0 |
| H18Y/A26E/A71G/D90G | 2898 | 19878 | 14.6 | 2001 | 45.6 | 15491 | 355.3 | 7.7 |
| H18Y/A26E/E35D/D90G | 2899 | 22813 | 16.8 | 46.5 | 1.1 | 10019 | 229.8 | 215.5 |
| H18Y/A26E/E35D/M47L | 2900 | 23990 | 17.7 | 324 | 7.4 | 9951 | 228.2 | 30.7 |
| E35D/V68M/A71G/D90G | 2901 | 23290 | 17.1 | 2843 | 64.8 | 28005 | 642.3 | 9.9 |
| E35D/M47L/A71G/D90G | 2902 | 20921 | 15.4 | 1331 | 30.3 | 12073 | 276.9 | 9.1 |
| E35D/M47L/V68M/D90G | 2903 | 27607 | 20.3 | 3414 | 77.8 | 23482 | 538.6 | 6.9 |
| E35D/M47L/V68M/A71G | 2904 | 24656 | 18.1 | 806 | 18.4 | 27872 | 639.3 | 34.6 |
| A26E/V68M/A71G/D90G | 2905 | 8666 | 6.4 | 1194 | 27.2 | 3195 | 73.3 | 2.7 |
| A26E/M47L/A71G/D90G | 2906 | 21955 | 16.2 | 1955 | 44.5 | 13204 | 302.8 | 6.8 |
| A26E/M47L/V68M/D90G | 2907 | 21900 | 16.1 | 2583 | 58.8 | 10626 | 243.7 | 4.1 |
| A26E/M47L/V68M/A71G | 2908 | 3227 | 2.4 | 98.7 | 2.2 | 1667 | 38.2 | 16.9 |
| A26E/E35D/V68M/D90G | 2910 | 13879 | 10.2 | 1683 | 38.3 | 6987 | 160.3 | 4.2 |
| A26E/E35D/V68M/A71G | 2911 | 11791 | 8.7 | 135 | 3.1 | 12611 | 289.2 | 93.4 |
| A26E/E35D/M47L/D90G | 2912 | 18167 | 13.4 | 1550 | 35.3 | 9577 | 219.7 | 6.2 |
| A26E/E35D/M47L/A71G | 2256 | 20645 | 15.2 | 236 | 5.4 | 11666 | 267.6 | 49.4 |
| H18Y/M47L/A71G/D90G | 2914 | 18162 | 13.4 | 1601 | 36.5 | 10796 | 247.6 | 6.7 |
| H18Y/M47L/V68M/D90G | 2915 | 19006 | 14.0 | 3795 | 86.4 | 21768 | 499.3 | 5.7 |
| H18Y/M47L/V68M/A71G | 2916 | 21298 | 15.7 | 1192 | 27.2 | 28478 | 653.2 | 23.9 |
| H18Y/E35D/A71G/D90G | 2917 | 25886 | 19.0 | 1310 | 29.8 | 8524 | 195.5 | 6.5 |
| H18Y/E35D/M47L/A71G | 2921 | 22368 | 16.5 | 604 | 13.8 | 11881 | 272.5 | 19.7 |
| H18Y/A26E/V68M/D90G | 2923 | 25794 | 19.0 | 2394 | 54.5 | 12845 | 294.6 | 5.4 |
| H18Y/A26E/V68M/A71G | 2924 | 11323 | 8.3 | 99.4 | 2.3 | 6866 | 157.5 | 69.1 |
| H18Y/A26E/M47L/D90G | 2925 | 23485 | 17.3 | 2858 | 65.1 | 8933 | 204.9 | 3.1 |
| H18Y/A26E/M47L/A71G | 2926 | 22108 | 16.3 | 611 | 13.9 | 15563 | 356.9 | 25.5 |
| H18Y/A26E/E35D/V68M | 2929 | 20929 | 15.4 | 372 | 8.5 | 17904 | 410.6 | 48.1 |
| H18Y/A26E/E35D/M47L/ V68M/A71G/D90G | 2276 | 18244 | 13.4 | 1836 | 41.8 | 29167 | 669.0 | 15.9 |
| CD80 WT IgV-Fc | 3031 | 1359 | 1.0 | 43.9 | 1.0 | 43.6 | 1.0 | 1.0 |
| CD80 ECD-Fc | 2 | 19552 | 14.4 | 42.3 | 1.0 | 6377 | 146.3 | 150.8 |
| Fc1.1 Control | 1714 | 37.9 | 0.0 | 15.4 | 0.4 | 77.1 | 1.8 | 5.0 |

TABLE 31

| Jurkat/IL2 + CHO/OKT3/PD-L1 Reporter Assay: Relative Luciferase Units (RLU) | | | |
|---|---|---|---|
| Mutation(s) | SEQ ID NO | CD80 Conc 5.0 nM | Fold Increase over WT CD80-IgV-Fc |
| E35D | 198 | 368 | 3.2 |
| M47L | 2814 | 530 | 4.6 |
| V68M | 2815 | 130 | 1.1 |
| L85Q | 2816 | 132 | 1.1 |
| E35D/D46V | 2817 | 609 | 5.3 |
| E35D/M47L | 208 | 603 | 5.2 |
| D46V/M47L | 2820 | 773 | 6.7 |
| D46V/V68M | 2821 | 292 | 2.5 |
| D46V/L85Q | 2822 | 342 | 3.0 |
| M47L/L85Q | 2824 | 416 | 3.6 |
| V68M/L85Q | 2825 | 146 | 1.3 |
| E35D/D46V/M47L | 2826 | 746 | 6.5 |
| E35D/D46V/V68M | 2827 | 799 | 6.9 |
| E35D/D46V/L85Q | 2828 | 410 | 3.6 |
| E35D/M47L/V68M | 2756 | 749 | 6.5 |
| E35D/M47L/L85Q | 2203 | 177 | 1.5 |
| E35D/V68M/L85Q | 2829 | 511 | 4.4 |
| D46V/M47L/V68M | 2830 | 724 | 6.3 |
| D46V/M47L/L85Q | 2831 | 598 | 5.2 |
| D46V/V68M/L85Q | 2832 | 267 | 2.3 |
| M47L/V68M/L85Q | 2833 | 238 | 2.1 |
| E35D/D46V/M47L/V68M | 2761 | 681 | 5.9 |
| E35D/D46V/M47L/L85Q | 2834 | 481 | 4.2 |
| E35D/D46V/V68M/L85Q | 2835 | 864 | 7.5 |
| E35D/M47L/V68M/L85Q | 2836 | 890 | 7.7 |
| D46V/M47L/V68M/L85Q | 2837 | 654 | 5.7 |
| E35D/D46V/M47L/V68M/L85Q | 2760 | 712 | 6.2 |
| M47V | 2838 | 445 | 3.9 |
| N48K | 2839 | 160 | 1.4 |
| K89N | 2840 | 116 | 1.0 |
| E35D/M47V | 2729 | 543 | 4.7 |
| E35D/N48K | 2841 | 590 | 5.1 |
| E35D/K89N | 2842 | 293 | 2.5 |
| M47V/N48K | 2843 | 490 | 4.3 |
| M47V/V68M | 2844 | 553 | 4.8 |
| M47V/K89N | 2845 | 312 | 2.7 |
| N48K/V68M | 2846 | 127 | 1.1 |
| N48K/K89N | 2847 | 127 | 1.1 |
| V68M/K89N | 2848 | 100 | 0.9 |
| E35D/M47V/N48K | 2849 | 561 | 4.9 |
| E35D/M47V/V68M | 2850 | 841 | 7.3 |
| E35D/M47V/K89N | 2851 | 668 | 5.8 |
| E35D/N48K/V68M | 2852 | 721 | 6.3 |
| E35D/N48K/K89N | 2853 | 719 | 6.3 |
| E35D/V68M/K89N | 2854 | 537 | 4.7 |
| M47V/N48K/V68M | 2855 | 664 | 5.8 |
| M47V/N48K/K89N | 2856 | 472 | 4.1 |
| M47V/V68M/K89N | 2857 | 862 | 7.5 |
| N48K/V68M/K89N | 2858 | 614 | 5.3 |
| E35D/M47V/N48K/V68M | 2764 | 747 | 6.5 |
| E35D/M47V/N48K/K89N | 2859 | 814 | 7.1 |
| E35D/M47V/V68M/K89N | 2860 | 779 | 6.8 |
| E35D/N48K/V68M/K89N | 2861 | 772 | 6.7 |
| M47V/N48K/V68M/K89N | 2862 | 671 | 5.8 |
| E35D/D46V/M47V/N48K/V68M | 2863 | 696 | 6.1 |
| E35D/D46V/M47V/V68M/L85Q | 2864 | 980 | 8.5 |
| E35D/D46V/M47V/V68M/K89N | 2865 | 817 | 7.1 |
| E35D/M47V/N48K/V68M/L85Q | 2866 | 907 | 7.9 |
| E35D/M47V/N48K/V68M/K89N | 2250 | 767 | 6.7 |
| E35D/M47V/V68M/L85Q/K89N | 2867 | 854 | 7.4 |
| CD80 WT IgV-Fc | 3031 | 115 | 1.0 |
| CD80 ECD-Fc | 2 | 131 | 1.1 |
| Fc1.1 Control | 1714 | 97 | 0.8 |

TABLE 32

| Jurkat/IL2 + CHO/OKT3/PD-L1 Reporter Assay: Relative Luciferase Units (RLU) | | | |
|---|---|---|---|
| Mutation(s) | SEQ ID NO | CD80 Conc 5.0 nM | Fold Increase over WT CD80-IgV-Fc |
| A26E/E35D/M47L/V68M/A71G/D90G | 2868 | 1117 | 2.86 |
| H18Y/E35D/M47L/V68M/A71G/D90G | 2869 | 1028 | 2.64 |
| H18Y/A26E/M47L/V68M/A71G/D90G | 2870 | 853 | 2.19 |
| H18Y/A26E/E35D/V68M/A71G/D90G | 2871 | 940 | 2.41 |
| H18Y/A26E/E35D/M47L/A71G/D90G | 2872 | 1015 | 2.60 |
| H18Y/A26E/E35D/M47L/V68M/D90G | 2873 | 893 | 2.29 |
| H18Y/A26E/E35D/M47L/V68M/A71G | 2874 | 976 | 2.50 |
| E35D/M47L/V68M/A71G/D90G | 2875 | 1041 | 2.67 |
| H18Y/M47L/V68M/A71G/D90G | 2876 | 986 | 2.53 |
| H18Y/A26E/V68M/A71G/D90G | 2877 | 974 | 2.50 |
| H18Y/A26E/E35D/A71G/D90G | 2878 | 956 | 2.45 |
| H18Y/A26E/E35D/M47L/D90G | 2879 | 925 | 2.37 |
| H18Y/A26E/E35D/M47L/V68M | 2880 | 895 | 2.29 |
| A26E/M47L/V68M/A71G/D90G | 2881 | 793 | 2.03 |
| A26E/E35D/V68M/A71G/D90G | 2882 | 912 | 2.34 |
| A26E/E35D/M47L/A71G/D90G | 2883 | 1132 | 2.90 |
| A26E/E35D/M47L/V68M/D90G | 2884 | 1091 | 2.80 |
| A26E/E35D/M47L/V68M/A71G | 2885 | 1010 | 2.59 |
| H18Y/E35D/V68M/A71G/D90G | 2886 | 815 | 2.09 |
| H18Y/E35D/M47L/A71G/D90G | 2887 | 851 | 2.18 |
| H18Y/E35D/M47L/V68M/D90G | 2888 | 852 | 2.18 |
| H18Y/E35D/M47L/V68M/A71G | 2889 | 853 | 2.19 |
| H18Y/A26E/M47L/A71G/D90G | 2890 | 1036 | 2.66 |
| H18Y/A26E/M47L/V68M/D90G | 2891 | 1075 | 2.76 |
| H18Y/A26E/M47L/V68M/A71G | 2892 | 1160 | 2.97 |
| H18Y/A26E/E35D/V68M/D90G | 2893 | 1049 | 2.69 |
| H18Y/A26E/E35D/V68M/A71G | 2894 | 961 | 2.46 |
| H18Y/A26E/E35D/M47L/A71G | 2895 | 944 | 2.42 |
| M47L/V68M/A71G/D90G | 2896 | 771 | 1.98 |
| H18Y/V68M/A71G/D90G | 2897 | 797 | 2.04 |
| H18Y/A26E/A71G/D90G | 2898 | 933 | 2.39 |
| H18Y/A26E/E35D/D90G | 2899 | 948 | 2.43 |
| H18Y/A26E/E35D/M47L | 2900 | 1208 | 3.10 |
| E35D/V68M/A71G/D90G | 2901 | 990 | 2.54 |
| E35D/M47L/A71G/D90G | 2902 | 784 | 2.01 |
| E35D/M47L/V68M/D90G | 2903 | 711 | 1.82 |
| E35D/M47L/V68M/A71G | 2904 | 745 | 1.91 |
| A26E/V68M/A71G/D90G | 2905 | 590 | 1.51 |
| A26E/M47L/A71G/D90G | 2906 | 827 | 2.12 |
| A26E/M47L/V68M/D90G | 2907 | 821 | 2.11 |
| A26E/M47L/V68M/A71G | 2908 | 517 | 1.33 |
| A26E/E35D/V68M/D90G | 2910 | 871 | 2.23 |
| A26E/E35D/V68M/A71G | 2911 | 839 | 2.15 |
| A26E/E35D/M47L/D90G | 2912 | 843 | 2.16 |
| A26E/E35D/M47L/A71G | 2256 | 766 | 1.96 |
| H18Y/M47L/A71G/D90G | 2914 | 675 | 1.73 |
| H18Y/M47L/V68M/D90G | 2915 | 834 | 2.14 |
| H18Y/M47L/V68M/A71G | 2916 | 881 | 2.26 |
| H18Y/E35D/A71G/D90G | 2917 | 1487 | 3.81 |
| H18Y/E35D/M47L/A71G | 2921 | 1387 | 3.56 |
| H18Y/A26E/V68M/D90G | 2923 | 1131 | 2.90 |
| H18Y/A26E/V68M/A71G | 2924 | 469 | 1.20 |
| H18Y/A26E/M47L/D90G | 2925 | 1159 | 2.97 |
| H18Y/A26E/M47L/A71G | 2926 | 1107 | 2.84 |
| H18Y/A26E/E35D/V68M | 2929 | 1214 | 3.11 |
| CD80 WT IgV-Fc | 3031 | 390 | 1.00 |

Example 15

Variant Optimization Via NNK Library Selection

Additional variant CD80 IgV domain-containing molecules were generated with combinations of mutations at positions 18, 26, 35, 47, 48, 68, 71, 85, 88, 90 and 93 with reference to positions set forth in SEQ ID NOs: 2250, 2276, and 2280. The variants were generated from an NNK library at the selected positions, where N=A,G,C or T and K=T or G, such that the degenerate codons encode all potential amino acids, but prevent the encoding of two stop residues TAA and TGA. The NNK containing DNA was introduced into yeast substantially as described in Example 2 to generate yeast libraries. The libraries were used to select yeast expressing affinity modified variants of CD80 substantially as described in Example 3.

Outputs from three rounds of FACS selections with rhPD-L1-Fc substantially as described in Example 4 were further formatted, selected and expressed as inert Fc-fusion proteins substantially as described in Example 5. The Fc-fusion proteins were tested for binding, substantially as described in Example 7, and bioactivity, substantially described in Example 9. Binding and bioactivity of wild-type CD80 ECD-Fc (inert), wild-type CD80 IgV-Fc (inert), H18Y/A26E/E35D/M47L/V68M/A71G/D90G (SEQ ID NO: 2276) CD80 IgV-Fc (inert), and inert Fc alone were also measured for reference. Results from the binding and activity studies are provided in Tables 33 and 34, respectively.

TABLE 33

Flow Binding to Jurkats (CD28) and CHO cells stably expressing CTLA4 or PD-L1

| CD80 Mutation(s) | SEQ ID NO: | CTLA4 MFI at 33.3 nM | CTLA4 Fold change to WT CD80 | CD28 MFI at 33.3 nM | CD28 Fold change to WT CD80 | PD-L1 MFI at 33.3 nM | PD-L1 Fold change to WT CD80 | Ratio of PDL1: CD28 |
|---|---|---|---|---|---|---|---|---|
| H18Y/E35D/M47V/V68M/A71G | 2992 | 23650 | 17.1 | 3227 | 31.6 | 64919 | 393.4 | 20.1 |
| H18C/A26P/E35D/M47L/V68M/A71G | 2993 | 23371 | 16.9 | 1906 | 18.7 | 67010 | 406.1 | 35.2 |
| H18I/A26P/E35D/M47V/V68M/A71G | 2994 | 21923 | 15.8 | 2573 | 25.2 | 64919 | 393.4 | 25.2 |
| H18L/A26N/D46E/V68M/A71G/D90G | 2995 | 17045 | 12.3 | 7253 | 71.1 | 67999 | 412.1 | 9.4 |
| H18L/E35D/M47V/V68M/A71G/D90G | 2996 | 20280 | 14.7 | 6349 | 62.2 | 64761 | 392.5 | 10.2 |
| H18T/A26N/E35D/M47L/V68M/A71G | 2997 | 20911 | 15.1 | 1366 | 13.4 | 68498 | 415.1 | 50.1 |
| H18V/A26K/E35D/M47L/V68M/A71G | 2998 | 22932 | 16.6 | 3641 | 35.7 | 67338 | 408.1 | 18.5 |
| H18V/A26N/E35D/M47V/V68M/A71G | 2999 | 22395 | 16.2 | 1297 | 12.7 | 68165 | 413.1 | 52.6 |
| H18V/A26P/E35D/M47V/V68L/A71G | 3000 | 13669 | 9.9 | 2253 | 22.1 | 55417 | 335.9 | 24.6 |
| H18V/A26P/E35D/M47L/V68M/A71G | 3001 | 16192 | 11.7 | 2452 | 24.0 | 52405 | 317.6 | 21.4 |
| H18V/E35D/M47V/V68M/A71G/D90G | 3002 | 16769 | 12.1 | 2115 | 20.7 | 43588 | 264.2 | 20.6 |
| H18Y/A26P/E35D/M47I/V68M/A71G | 3003 | 12156 | 8.8 | 5125 | 50.2 | 54482 | 330.2 | 10.6 |
| H18Y/A26P/E35D/M47V/V68M/A71G | 3004 | 17904 | 12.9 | 6911 | 67.8 | 51521 | 312.2 | 7.5 |
| H18Y/E35D/M47V/V68L/A71G/D90G | 3005 | 16458 | 11.9 | 2549 | 25.0 | 47905 | 290.3 | 18.8 |
| H18Y/E35D/M47V/V68M/A71G/D90G | 3006 | 17165 | 12.4 | 6792 | 66.6 | 52151 | 316.1 | 7.7 |
| A26P/E35D/M47I/V68M/A71G/D90G | 3007 | 19761 | 14.3 | 8189 | 80.3 | 54747 | 331.8 | 6.7 |
| H18V/A26G/E35D/M47V/V68M/A71G/D90G | 3008 | 25398 | 18.4 | 8189 | 80.3 | 66198 | 401.2 | 8.1 |
| H18V/A26S/E35D/M47L/V68M/A71G/D90G | 3009 | 24919 | 18.0 | 8063 | 79.0 | 73884 | 447.8 | 9.2 |
| H18V/A26R/E35D/M47L/V68M/A71G/D90G | 3010 | 23151 | 16.7 | 9620 | 94.3 | 73166 | 443.4 | 7.6 |
| H18V/A26D/E35D/M47V/V68M/A71G/D90G | 3011 | 22132 | 16.0 | 6253 | 61.3 | 67503 | 409.1 | 10.8 |
| H18V/A26Q/E35D/M47V/V68L/A71G/D90G | 3012 | 17654 | 12.8 | 3126 | 30.6 | 33597 | 203.6 | 10.7 |
| H18A/A26P/E35D/M47L/V68M/A71G/D90G | 3013 | 23763 | 17.2 | 4731 | 46.4 | 33436 | 202.6 | 7.1 |
| H18A/A26N/E35D/M47L/V68M/A71G/D90G | 3014 | 21360 | 15.4 | 4913 | 48.2 | 36284 | 219.9 | 7.4 |
| H18F/A26P/E35D/M47I/V68M/A71G/D90G | 3015 | 23932 | 17.3 | 4801 | 47.1 | 32253 | 195.5 | 6.7 |
| H18F/A26H/E35D/M47L/V68M/A71G/D90G | 3016 | 16420 | 11.9 | 8392 | 82.3 | 20666 | 125.2 | 2.5 |
| H18F/A26N/E35D/M47V/V68M/A71G/D90K | 3017 | 15206 | 11.0 | 3170 | 31.1 | 22395 | 135.7 | 7.1 |
| H18Y/A26N/E35D/M47F/V68M/A71G/D90G | 3018 | 14618 | 10.6 | 82.2 | 0.8 | 26510 | 160.7 | 322.5 |
| H18Y/A26P/E35D/M47Y/V68I/A71G/D90G | 3019 | 8281 | 6.0 | 1818 | 17.8 | 27280 | 165.3 | 15.0 |
| H18Y/A26Q/E35D/M47T/V68M/A71G/D90G | 3020 | 16652 | 12.0 | 6733 | 66.0 | 24450 | 148.2 | 3.6 |
| H18R/A26P/E35D/D46N/M47V/V68M/A71G/D90P | 3021 | 17327 | 12.5 | 18589 | 182.2 | 29306 | 177.6 | 1.6 |
| H18F/A26D/E35D/D46E/M47T/V68M/A71G/D90G | 3022 | 17205 | 12.4 | 6028 | 59.1 | 27541 | 166.9 | 4.6 |
| H18Y/A26E/E35D/M47L/V68M/A71G/D90G | 2276 | 21512 | 15.5 | 5202 | 51.0 | 35251 | 213.6 | 6.8 |
| CD 80 WT IgV-Fc | | 1384 | 1.0 | 102 | 1.0 | 165 | 1.0 | 1.6 |
| CD 80 WT ECD-Fc | | 17862 | 12.9 | 57.8 | 0.6 | 161 | 1.0 | 2.8 |
| Fc1.1 Control | | 194 | 0.1 | 81 | 0.8 | 185 | 1.1 | 2.3 |

TABLE 34

| Jurkat/IL2 + CHO/OKT3/PD-L1 Reporter Assay: Relative Luciferase Units (RLU) | | | |
|---|---|---|---|
| CD80 Mutation(s) | SEQ ID NO: | CD80 Conc 5.0 nM | Fold Increase over WT CD80-IgV-Fc |
| H18Y/E35D/M47V/V68M/A71G | 2992 | 963 | 5.6 |
| H18C/A26P/E35D/M47L/V68M/A71G | 2993 | 936 | 5.5 |
| H18I/A26P/E35D/M47V/V68M/A71G | 2994 | 916 | 5.4 |
| H18L/A26N/D46E/V68M/A71G/D90G | 2995 | 815 | 4.8 |
| H18L/E35D/M47V/V68M/A71G/D90G | 2996 | 910 | 5.3 |
| H18T/A26N/E35D/M47L/V68M/A71G | 2997 | 1053 | 6.2 |
| H18V/A26K/E35D/M47L/V68M/A71G | 2998 | 957 | 5.6 |
| H18V/A26N/E35D/M47V/V68M/A71G | 2999 | 985 | 5.8 |
| H18V/A26P/E35D/M47V/V68L/A71G | 3000 | 881 | 5.2 |
| H18V/A26P/E35D/M47L/V68M/A71G | 3001 | 808 | 4.7 |
| H18V/E35D/M47V/V68M/A71G/D90G | 3002 | 854 | 5.0 |
| H18Y/A26P/E35D/M47I/V68M/A71G | 3003 | 761 | 4.5 |
| H18Y/A26P/E35D/M47V/V68M/A71G | 3004 | 821 | 4.8 |
| H18Y/E35D/M47V/V68L/A71G/D90G | 3005 | 862 | 5.0 |
| H18Y/E35D/M47V/V68M/A71G/D90G | 3006 | 825 | 4.8 |
| A26P/E35D/M47I/V68M/A71G/D90G | 3007 | 823 | 4.8 |
| H18V/A26G/E35D/M47V/V68M/A71G/D90G | 3008 | 907 | 5.3 |
| H18V/A26S/E35D/M47L/V68M/A71G/D90G | 3009 | 883 | 5.2 |
| H18V/A26R/E35D/M47L/V68M/A71G/D90G | 3010 | 738 | 4.3 |
| H18V/A26D/E35D/M47V/V68M/A71G/D90G | 3011 | 771 | 4.5 |
| H18V/A26Q/E35D/M47V/V68L/A71G/D90G | 3012 | 795 | 4.6 |
| H18A/A26P/E35D/M47L/V68M/A71G/D90G | 3013 | 857 | 5.0 |
| H18A/A26N/E35D/M47L/V68M/A71G/D90G | 3014 | 1054 | 6.2 |
| H18F/A26P/E35D/M47I/V68M/A71G/D90G | 3015 | 926 | 5.4 |
| H18F/A26H/E35D/M47L/V68M/A71G/D90G | 3016 | 907 | 5.3 |
| H18F/A26N/E35D/M47V/V68M/A71G/D90K | 3017 | 919 | 5.4 |
| H18Y/A26N/E35D/M47F/V68M/A71G/D90G | 3018 | 911 | 5.3 |
| H18Y/A26P/E35D/M47Y/V68I/A71G/D90G | 3019 | 865 | 5.1 |
| H18Y/A26Q/E35D/M47T/V68M/A71G/D90G | 3020 | 994 | 5.8 |
| H18R/A26P/E35D/D46N/M47V/V68M/A71G/D90P | 3021 | 972 | 5.7 |
| H18F/A26D/E35D/D46E/M47T/V68M/A71G/D90G | 3022 | 833 | 4.9 |
| H18Y/A26E/E35D/M47L/V68M/A71G/D90G | 2276 | 912 | 5.3 |
| CD80 WT IgV-Fc | 3031 | 171 | 1.0 |
| CD80 WT ECD-Fc | 2 | 159 | 0.9 |
| Fc1.1 Control | 1714 | 129 | 0.8 |

Example 16

CD80 IgV-Fc Linker Variants

CD80 IgV-Fc variants were constructed with different linking regions (linkers) between the IgV and Fe domains and binding and/or bioactivity was assessed. Fusion proteins, containing CD80 E35D/M47V/N48K/V68M/K89N IgV-Fc and E35D/D46V/M47L/V68M/L85Q/E88D IgV-Fc proteins, were generated containing EAAAK (SEQ ID NO: 3026), $(EAAAK)_3$ (SEQ ID NO: 3027), $GS(G_4S)_3$ (SEQ ID NO: 3028), $GS(G_4S)_5$ (SEQ ID NO: 3029) linkers.

CD80 IgV-Fc proteins were also generated that contained the E35D/M47V/N48K/V68M/K89N or E35D/D46V/M47L/V68M/L85Q/E88D modifications in a CD80 IgV backbone sequence that was deleted for three amino acids that connect the IgV to IgC in wildtype CD80 (backbone sequence set forth in SEQ ID NO: 3030). The generated variant CD80 IgV was then fused to an inert Fc that was additionally lacking 6 amino acids of the hinge region (Fc set forth in SEQ ID NO: 3025). Molecules generated by this strategy were fused directly to the Fc with no additional linker, designated as "delta" linker.

The CD80-IgV-Fc variants were then tested for binding and bioactivity as described in Examples 7 and 9. Binding and bioactivity of wild-type CD80 IgV (SEQ ID NO: 3031)-Fc (inert), CD80 ECD (SEQ ID NO:2)-Fc (inert), containing a GSG4S linker (SEQ ID NO: 1716) and inert Fc alone were also measured for comparison. The results are provided in Tables 34 and 35, respectively.

TABLE 34

| Flow Binding to Jurkats (CD28) and CHO cells stably expressing CTLA4 or PD-L1 | | | | | | | | |
|---|---|---|---|---|---|---|---|---|
| | | CTLA4 | | CD28 | | PD-L1 | | |
| Mutation(s) | linker | MFI at 33.3 nM | Fold change to WT CD80 | MFI at 33.3 nM | Fold change to WT CD80 | MFI at 33.3 nM | Fold change to WT CD80 | Ratio of PDL1: CD28 |
| E35D/M47V/N48K/ V68M/K89N | delta | 3091 | 2.6 | 4678 | 83.7 | 20442 | 438.7 | 4 |
| | EAAAK | 27516 | 23.0 | 2634 | 47.1 | 22862 | 490.6 | 9 |
| | $(EAAAK)_3$ | 27132 | 22.6 | 1285 | 23.0 | 24476 | 525.2 | 19 |
| | $GS(G_4S)_3$ | 29793 | 24.9 | 2109 | 37.7 | 24222 | 519.8 | 11 |
| | $GS(G4S)_5$ | 26994 | 22.5 | 1154 | 20.6 | 22707 | 487.3 | 20 |

TABLE 34-continued

Flow Binding to Jurkats (CD28) and CHO cells stably expressing CTLA4 or PD-L1

| | | CTLA4 | | CD28 | | PD-L1 | | |
|---|---|---|---|---|---|---|---|---|
| Mutation(s) | linker | MFI at 33.3 nM | Fold change to WT CD80 | MFI at 33.3 nM | Fold change to WT CD80 | MFI at 33.3 nM | Fold change to WT CD80 | Ratio of PDL1: CD28 |
| E35D/D46V/M47L/ | delta | 12177 | 10.2 | 4173 | 74.7 | 22538 | 483.6 | 5 |
| V68M/L85Q/E88D | EAAAK | 28959 | 24.2 | 563 | 10.1 | 24821 | 532.6 | 44 |
| | $(EAAAK)_3$ | 32048 | 26.8 | 197 | 3.5 | 25461 | 546.4 | 129 |
| | $GS(G_4S)_3$ | 26961 | 22.5 | 267 | 4.8 | 22596 | 484.9 | 85 |
| | $GS(G_4S)_5$ | 26607 | 22.2 | 143 | 2.6 | 22408 | 480.9 | 157 |
| CD80 WT IgV-Fc | $GSG_4S$ | 1198 | 1.0 | 56 | 1.0 | 47 | 1.0 | 1 |
| CD80 ECD-Fc | $GSG_4S$ | 32735 | 27.3 | 37 | 0.7 | 35 | 0.7 | 1 |
| Inert Fc (control) | N/A | 40 | 0.0 | 20 | 0.3 | 58 | 1.2 | 3 |

TABLE 35

Jurkat/IL2 + CHO/OKT3/PD-L1 Reporter Assay: Relative Luciferase Units (RLU)

| Mutation(s) | linker | CD80 Conc 5.0 nM | Fold Increase over WT CD80-IgV-Fc |
|---|---|---|---|
| E35D/M47V/N48K/V68M/K89N | delta | 1026 | 2.63 |
| | EAAAK | 1707 | 4.38 |
| | $(EAAAK)_3$ | 1761 | 4.52 |
| | $GS(G_4S)_3$ | 1400 | 3.59 |
| | $GS(G4S)_5$ | 1541 | 3.95 |
| E35D/D46V/M47L/V68M/L85Q/E88D | delta | 1079 | 2.77 |
| | EAAAK | 1462 | 3.75 |
| | $(EAAAK)_3$ | 2046 | 5.25 |
| | $GS(G_4S)_3$ | 1592 | 4.08 |
| | $GS(G4S)_5$ | 2053 | 5.26 |
| CD80 WT IgV-Fc | $GSG_4S$ | 390 | 1.00 |

Example 17

Additional Affinity Modified IgSF Domains

This example describes the design, creation, and screening of additional affinity modified CD155, CD112, PD-L1, PD-L2 and CD86 (7-2) immunomodulatory proteins, which are other components of the immune synapse (IS) that have a demonstrated dual role in both immune activation and inhibition. Affinity-modified NKp30 variants also were generated and screened. These examples demonstrate that affinity modification of IgSF domains yields proteins that can act to both increase and decrease immunological activity. Various combinations of those domains fused in pairs (i.e., stacked) with a variant affinity modified CD80 to form a Type II immunomodulatory protein to achieve immunomodulatory activity.

Mutant DNA constructs of encoding a variant of the IgV domain of human CD155, CD112, CD80, PD-L1 and PD-L2 for translation and expression as yeast display libraries were generated substantially as described in Example 1. For target libraries that target specific residues for complete or partial randomization with degenerate codons and/or random libraries were constructed to identify variants of the IgV of CD112 (SEQ ID NO: 829), CD155(SEQ ID NO: 421), PD-L1 (SEQ ID NO:1196), and variants of the IgV of PD-L2 (SEQ ID NO:1257) substantially as described in Example 1. Similar methods also were used to generate libraries of the IgC-like domain of NKp30 (SEQ ID NO:355).

The degenerate or random library DNA was introduced into yeast substantially as described in Example 2 to generate yeast libraries. The libraries were used to select yeast expressing affinity modified variants of CD155, CD112, PD-L1, PD-L2, CD86 (B7-2), and NKp30 substantially as described in Example 3. Cells were processed to reduce non-binders and to enrich for CD155, CD112, PD-L1 or PD-L2 variants with the ability to bind their exogenous recombinant counter-structure proteins substantially as described in Example 3.

With CD80, CD86 and NKp30 libraries, target ligand proteins were sourced from R&D Systems (USA) as follows: human rCD28.Fc (i.e., recombinant CD28-Fc fusion protein), rPDL1.Fc, rCTLA4.Fc, and rB7H6.Fc. Two-color flow cytometry was performed substantially as described in Example 3. Yeast outputs from the flow cytometric sorts were assayed for higher specific binding affinity. Sort output yeast were expanded and re-induced to express the particular IgSF affinity modified domain variants they encode. This population then can be compared to the parental, wild-type yeast strain, or any other selected outputs, such as the bead output yeast population, by flow cytometry.

In the case of NKp30 yeast variants selected for binding to B7-H6, the F2 sort outputs gave MFI values of 533 when stained with 16.6 nM rB7H6.Fc, whereas the parental NKp30 strain MFI was measured at 90 when stained with the same concentration of rB7H6.Fc (6-fold improvement).

Among the NKp30 variants that were identified, was a variant that contained mutations L30V/A60V/S64P/S86G with reference to positions in the NKp30 extracellular domain corresponding to positions set forth in SEQ ID NO:275.

For CD155 variants provided in Table 20A, CD155 libraries were selected against each of TIGIT, CD96, and CD226, separately. For CD155 variants provided in Table 20B-F, selection involved two positive selections with the desired counter structures TIGIT and CD96 followed by one negative selection with the counter structure CD226 to select away from CD226 and improve binding specificity of the variant CD155. Selection was performed essentially as described in Example 3 above except the concentrations of the counter structures (TIGIT/CD96) and selection stringency of the positive sorts were varied to optimize lead identification. The concentration of CD226 for the negative selection was kept at 100 nM.

For CD112 variants provided in Table 21A, CD112 libraries were selected against each of TIGIT, CD112R, and CD226, separately. For additional CD112 variants provided in Table 21B-C, selection involved two positive selections with the desired counter structures TIGIT and CD112R followed by one negative selection with the counter structure CD226 to select away from CD226 and improve binding specificity of the variant CD112. Selection was performed essentially as described in Example 3 above except the concentrations of the counter structures (TIGIT/CD112R) and selection stringency of the positive sorts were varied to optimize lead identification. The concentration of CD226 for the negative selection was kept at 100 nM.

For PD-L1 and PD-L2 shown in Tables 22A-C or Tables 23A and 23B, respectively, yeast display targeted or random PD-L1 or PD-L2 libraries were selected against PD-1. This was then followed by two to three rounds of flow cytometry sorting using exogenous counter-structure protein staining to enrich the fraction of yeast cells that displays improved binders. Alternatively, for PD-L1, selections were performed with human rCD80.Fc (i.e., human recombinant CD80 Fc fusion protein from R&D Systems, USA). Selections were carried out largely as described for PD-1 above. Magnetic bead enrichment and selections by flow cytometry are essentially as described in Miller, K. D., et al., Current Protocols in Cytometry 4.7.1-4.7.30, July 2008. PD-L1 variants in Table 22A-B were assessed for binding to cell-expressed counter structures. Additional PD-L1 variants identified in the screen as described above are set forth in Table 22C.

Exemplary selection outputs were reformatted as immunomodulatory proteins containing an affinity modified (variant) IgV of CD155, variant IgV of CD112, variant IgV of PD-L1, variant IgV of PD-L2, each fused to an Fc molecule (variant IgV-Fc fusion molecules) substantially as described in Example 4 and the Fc-fusion protein was expressed and purified substantially as described in Example 5.

Binding of exemplary IgSF domain variants to cell-expressed counter structures was then assessed substantially as described in Example 6. Cells expressing cognate binding partners were produced and binding studies and flow cytometry were carried out substantially as described in Example 6. In addition, the bioactivity of the Fc-fusion variant protein was characterized by either mixed lymphocyte reaction (MLR) or anti-CD3 coimmobilization assay substantially as described in Example 6.

As above, for each Table, the exemplary amino acid substitutions are designated by amino acid position number corresponding to the respective reference unmodified ECD sequence (Table 2). The amino acid position is indicated in the middle, with the corresponding unmodified (e.g. wild-type) amino acid listed before the number and the identified variant amino acid substitution listed (or inserted designated by a) after the number.

Also shown is the binding activity as measured by the Mean Fluorescence Intensity (MFI) value for binding of each variant Fc-fusion molecule to cells engineered to express the cognate counter structure ligand and the ratio of the MFI compared to the binding of the corresponding unmodified Fc fusion molecule not containing the amino acid substitution(s) to the same cell-expressed counter structure ligand. The functional activity of the PD-L2 variant Fc-fusion molecules to modulate the activity of T cells also is shown based on the calculated levels of IFN-gamma in culture supernatants (pg/mL) generated with the indicated variant Fc fusion molecule in an MLR assay. Table 23B also depicts the ratio of IFN-gamma produced by each variant IgV-Fc compared to the corresponding unmodified IgV-Fc in an MLR assay.

As shown, the selections resulted in the identification of a number of CD155, CD112, PD-L1, and PD-L2 IgSF domain variants that were affinity-modified to exhibit increased binding for at least one, and in some cases more than one, cognate counter structure ligand. In addition, the results showed that affinity modification of the variant molecules also exhibited improved activities to both increase and decrease immunological activity.

TABLE 20A

Variant CD155 selected against cognate binding partners. Molecule sequences, binding data, and costimulatory bioactivity data.

| CD155 mutations | CD226 tfxn MFI (CD226 MFI parental ratio) | TIGIT tfxn MFI (TIGIT MFI parental ratio) | CD96 MFI (CD96 MFI parental ratio) | Mock Expi293 MFI (Mock MFI parental ratio) | Anti-CD3 IFN-gamma (pg/mL) (Anti-CD3 IFN-gamma parental ratio) |
|---|---|---|---|---|---|
| P18S/P64S/F91S | 497825 (133.7) | 247219 (91.1) | 140065 (45.4) | 3528 (1.2) | 270.1 (0.7) |
| P18S/F91S/L104P | 26210 (7.0) | 75176 (27.7) | 10867 (3.5) | 2130 (0.7) | 364.2 (0.9) |
| L44P | 581289 (156.1) | 261931 (96.5) | 152252 (49.4) | 3414 (1.2) | 277.6 (0.7) |
| A56V | 455297 (122.3) | 280265 (103.2) | 161162 (52.2) | 2601 (0.9) | 548.2 (1.4) |
| P18L/L79V/F91S | 5135 (1.4) | 4073 (1.5) | 3279 (1.1) | 2719 (0.9) | 1241.5 (3.2) |
| P18S/F91S | 408623 (109.8) | 284190 (104.7) | 147463 (47.8) | 3348 (1.1) | 760.6 (2.0) |
| P18T/F91S | 401283 (107.8) | 223985 (82.5) | 157644 (51.1) | 3065 (1.1) | 814.7 (2.1) |
| P18T/S42P/F91S | 554105 (148.8) | 223887 (82.5) | 135395 (43.9) | 3796 (1.3) | 539.7 (1.4) |
| G7E/P18T/Y30C/F91S | 12903 (3.5) | 12984 (4.8) | 7906 (2.6) | 2671 (0.9) | 275.9 (0.7) |
| P18T/F91S/G111D | 438327 (117.7) | 287315 (105.8) | 167583 (54.3) | 4012 (1.4) | 307.2 (0.8) |
| P18S/F91P | 4154 (1.1) | 3220 (1.2) | 2678 (0.9) | 2816 (1.0) | 365.7 (0.9) |
| P18T/F91S/F108L | 394546 (106.0) | 298680 (110.0) | 193122 (62.6) | 2926 (1.0) | 775.4 (2.0) |
| P18T/T45A/F91S | 435847 (117.1) | 222044 (81.8) | 191026 (61.9) | 2948 (1.0) | 1546.8 (4.0) |

TABLE 20A-continued

| Variant CD155 selected against cognate binding partners. Molecule sequences, binding data, and costimulatory bioactivity data. | | | | | |
|---|---|---|---|---|---|
| CD155 mutations | CD226 tfxn MFI (CD226 MFI parental ratio) | TIGIT tfxn MFI (TIGIT MFI parental ratio) | CD96 MFI (CD96 MFI parental ratio) | Mock Expi293 MFI (Mock MFI parental ratio) | Anti-CD3 IFN-gamma (pg/mL) (Anti-CD3 IFN-gamma parental ratio) |
| P18T/F91S/R94H | 3589 (1.0) | 2942 (1.1) | 2509 (0.8) | 2390 (0.8) | 1273.2 (3.3) |
| P18S/Y30C/F91S | 382352 (102.7) | 276358 (101.8) | 56934 (18.5) | 3540 (1.2) | 426.5 (1.1) |
| A81V/L83P | 4169 (1.1) | 2912 (1.1) | 2616 (0.8) | 2993 (1.0) | 339.7 (0.9) |
| L88P | 65120 (17.5) | 74845 (27.6) | 35280 (11.4) | 2140 (0.7) | 969.2 (2.5) |
| Wild type | 3723 (1.0) | 2715 (1.0) | 3085 (1.0) | 2913 (1.0) | 389.6 (1.0) |
| R94H | 18905 (5.1) | 104013 (38.3) | 11727 (3.8) | 1663 (0.6) | 372.6 (1.0) |
| A13E/P18S/A56V/F91S | 357808 (96.1) | 179060 (66.0) | 118570 (38.4) | 2844 (1.0) | 349.2 (0.9) |
| P18T/F91S/V115A | 38487 (10.3) | 46313 (17.1) | 22718 (7.4) | 2070 (0.7) | 1574.5 (4.0) |
| P18T/Q60K | 238266 (64.0) | 173730 (64.0) | 154448 (50.1) | 4778 (1.6) | 427.2 (1.1) |

TABLE 20B

Additional CD15 Variants and Binding Data.

| | TIGIT | | CD226 | | CD112R | | CD96 | |
|---|---|---|---|---|---|---|---|---|
| CD155 Mutation(s) | MFI at 100 nM | Fold ↑ to WT ECD | MFI at 100 nM | Fold ↑ to WT ECD | MFI at 100 nM | Fold ↑ to WT ECD | MFI at 100 nM | Fold ↑ to WT ECD |
| S52M | 1865.3 | 0.00 | 1901.0 | 0.01 | 1553.4 | 0.87 | 1609.8 | 0.02 |
| T45Q/S52L/L104E/G111R | 2287.0 | 0.01 | 2390.4 | 0.01 | 1735.1 | 0.97 | 1575.1 | 0.02 |
| S42G | 4837.5 | 0.01 | 2448.1 | 0.01 | 1815.4 | 1.02 | 1699.6 | 0.02 |
| Q62F | 2209.5 | 0.01 | 2572.1 | 0.01 | 2706.5 | 1.52 | 2760.7 | 0.03 |
| S52Q | 2288.1 | 0.01 | 2022.3 | 0.01 | 1790.1 | 1.00 | 1822.3 | 0.02 |
| S42A/L104Q/G111R | 1923.7 | 0.00 | 1901.7 | 0.01 | 1815.1 | 1.02 | 1703.8 | 0.02 |
| S42A/S52Q/L104Q/G111R | 1807.5 | 0.00 | 2157.2 | 0.01 | 1894.4 | 1.06 | 1644.0 | 0.02 |
| S52W/L104E | 1938.2 | 0.00 | 1905.6 | 0.01 | 2070.6 | 1.16 | 1629.5 | 0.02 |
| S42C | 1914.0 | 0.00 | 2096.1 | 0.01 | 1685.0 | 0.95 | 1592.4 | 0.02 |
| S52W | 1991.6 | 0.00 | 2037.3 | 0.01 | 1612.8 | 0.90 | 1712.9 | 0.02 |
| S52M/L104Q | 2666.6 | 0.01 | 2252.2 | 0.01 | 1706.0 | 0.96 | 1633.1 | 0.02 |
| S42L/S52L/Q62F/L104Q | 2021.4 | 0.00 | 2643.8 | 0.02 | 1730.1 | 0.97 | 2318.7 | 0.02 |
| S42W | 2434.5 | 0.01 | 2133.4 | 0.01 | 2325.7 | 1.30 | 2555.4 | 0.03 |
| S42Q | 2073.5 | 0.00 | 2225.9 | 0.01 | 1905.1 | 1.07 | 2143.1 | 0.02 |
| S52L | 2224.8 | 0.01 | 2676.3 | 0.02 | 2038.6 | 1.14 | 2043.2 | 0.02 |
| S52R | 4395.4 | 0.01 | 3964.4 | 0.02 | 2741.7 | 1.54 | 4846.9 | 0.05 |
| L104E | 3135.4 | 0.01 | 2264.2 | 0.01 | 1803.5 | 1.01 | 1556.7 | 0.02 |
| G111R | 2082.7 | 0.00 | 2791.3 | 0.02 | 2470.9 | 1.39 | 3317.1 | 0.03 |
| S52E | 2655.4 | 0.01 | 2599.8 | 0.02 | 1904.9 | 1.07 | 1799.0 | 0.02 |
| Q62Y | 2528.6 | 0.01 | 2621.4 | 0.02 | 1918.4 | 1.08 | 1827.5 | 0.02 |
| T45Q/S52M/L104E | 79498.2 | 0.19 | 143238.5 | 0.83 | 2600.6 | 1.46 | 6310.4 | 0.06 |
| S42N/L104Q/G111R | 2432.1 | 0.01 | 2311.3 | 0.01 | 1847.4 | 1.04 | 1958.3 | 0.02 |
| S52M/V57L | 1760.7 | 0.00 | 2431.6 | 0.01 | 2006.9 | 1.13 | 1858.7 | 0.02 |
| S42N/S52Q/Q62F | 2402.7 | 0.01 | 2152.0 | 0.01 | 1855.0 | 1.04 | 1737.6 | 0.02 |
| S42A/S52L/L104E/G111R | 2262.7 | 0.01 | 1889.4 | 0.01 | 1783.2 | 1.00 | 1606.2 | 0.02 |
| S42W/S52Q/V57L/Q62Y | 1961.4 | 0.00 | 2138.3 | 0.01 | 1844.9 | 1.03 | 1699.6 | 0.02 |
| L104Q | 10314.4 | 0.02 | 3791.4 | 0.02 | 2119.9 | 1.19 | 1542.6 | 0.02 |
| S42L/S52Q/L104E | 1946.9 | 0.00 | 6474.3 | 0.04 | 1749.0 | 0.98 | 1702.2 | 0.02 |
| S42C/S52L | 1762.5 | 0.00 | 2147.3 | 0.01 | 1663.4 | 0.93 | 1484.7 | 0.01 |
| S42W/S52R/Q62Y/L104Q | 1918.8 | 0.00 | 2300.1 | 0.01 | 1824.6 | 1.02 | 1756.0 | 0.02 |
| T45Q/S52R/L104E | 121636.9 | 0.29 | 142381.2 | 0.82 | 2617.9 | 1.47 | 3748.2 | 0.04 |
| S52R/Q62F/L104Q/G111R | 2969.2 | 0.01 | 3171.6 | 0.02 | 1725.4 | 0.97 | 2362.3 | 0.02 |
| T45Q/S52L/V57L/L104E | 2857.7 | 0.01 | 5943.5 | 0.03 | 1496.8 | 0.84 | 1533.3 | 0.02 |
| S52M/Q62Y | 1926.6 | 0.00 | 2000.3 | 0.01 | 1771.6 | 0.99 | 1651.1 | 0.02 |
| Q62F/L104E/G111R | 1966.4 | 0.00 | 2043.5 | 0.01 | 1701.9 | 0.95 | 1524.8 | 0.02 |
| T45Q/S52Q | 4812.8 | 0.01 | 5787.5 | 0.03 | 1765.6 | 0.99 | 2451.3 | 0.02 |
| S52L/L104E | 4317.8 | 0.01 | 2213.9 | 0.01 | 1756.9 | 0.99 | 1829.3 | 0.02 |
| S42V/S52E | 2055.0 | 0.00 | 2272.6 | 0.01 | 1808.0 | 1.01 | 2530.2 | 0.03 |
| T45Q/S52R/G111R | 4092.3 | 0.01 | 2075.2 | 0.01 | 1793.6 | 1.01 | 2336.6 | 0.02 |
| S42G/S52Q/L104E/G111R | 2010.1 | 0.00 | 2019.2 | 0.01 | 1706.4 | 0.96 | 1707.6 | 0.02 |
| S42N/S52E/V57L/L104E | 1784.2 | 0.00 | 1743.6 | 0.01 | 1690.1 | 0.95 | 1538.7 | 0.02 |
| Wildtype | 1964.7 | 0.00 | 2317.1 | 0.01 | 2169.6 | 1.22 | 1893.4 | 0.02 |
| S42C/S52M/Q62F | 1861.0 | 0.00 | 2084.2 | 0.01 | 1592.3 | 0.89 | 1481.3 | 0.01 |
| S42L | 1930.4 | 0.00 | 2187.2 | 0.01 | 1743.2 | 0.98 | 1618.4 | 0.02 |
| Wildtype | 2182.6 | 0.01 | 2374.5 | 0.01 | 1743.1 | 0.98 | 1680.4 | 0.02 |
| S42A | 1929.2 | 0.00 | 2188.6 | 0.01 | 1733.7 | 0.97 | 1623.6 | 0.02 |
| S42G/S52L/Q62F/L104Q | 1924.3 | 0.00 | 2157.6 | 0.01 | 1661.3 | 0.93 | 1642.1 | 0.02 |

TABLE 20B-continued

| Additional CD15 Variants and Binding Data. | | | | | | | | |
|---|---|---|---|---|---|---|---|---|
| | TIGIT | | CD226 | | CD112R | | CD96 | |
| CD155 Mutation(s) | MFI at 100 nM | Fold ↑ to WT ECD | MFI at 100 nM | Fold ↑ to WT ECD | MFI at 100 nM | Fold ↑ to WT ECD | MFI at 100 nM | Fold ↑ to WT ECD |
| S42N | 1817.4 | 0.00 | 1910.9 | 0.01 | 1699.7 | 0.95 | 1691.5 | 0.02 |
| CD155 IgV Fc | 4690 | 0.01 | 4690 | 0.03 | 2941 | 1.65 | 3272 | 0.03 |
| Wildtype CD155 ECD-Fc | 423797 | 1.00 | 172839 | 1.00 | 1783 | 1.00 | 99037 | 1.00 |
| Anti-human Fc PE | 1506.3 | 0.00 | 3774 | 0.02 | 1587 | 0.89 | 1618 | 0.02 |

TABLE 20C

| Additional CD155 Variants and Binding Data. | | | | | | |
|---|---|---|---|---|---|---|
| | TIGIT | | CD226 | | CD96 | |
| CD155 Mutation(s) | MFI at 100 nM | Fold Increase to WT ECD | MFI at 100 nM | Fold Increase to WT ECD | MFI at 100 nM | Fold Increase to WT ECD |
| P18T/S65A/S67V/F91S | 297843 | 1.99 | 351195 | 3.22 | 128180 | 1.68 |
| P18T/T45Q/T61R/S65N/S67L | 224682 | 1.50 | 270175 | 2.48 | 22820 | 0.30 |
| P18F/S65A/S67V/F91S | 534106 | 3.57 | 350410 | 3.21 | 144069 | 1.89 |
| P18S/L79P/L104M | 342549 | 2.29 | 320823 | 2.94 | 107532 | 1.41 |
| P18S/L104M | 449066 | 3.00 | 295126 | 2.70 | 121266 | 1.59 |
| L79P/L104M | 3210 | 0.02 | 8323 | 0.08 | 2894 | 0.04 |
| P18T/T45Q/L79P | 542878 | 3.63 | 371498 | 3.40 | 193719 | 2.55 |
| P18T/T45Q/T61R/S65H/S67H | 312337 | 2.09 | 225439 | 2.07 | 152903 | 2.01 |
| A13R/D23Y/E37P/S42P/Q62Y/A81E | 4161 | 0.03 | 11673 | 0.11 | 5762 | 0.08 |
| P18L/E37S/Q62M/G80S/A81P/G99Y/S112N | 5900 | 0.04 | 14642 | 0.13 | 3345 | 0.04 |
| P18S/L104T | 321741 | 2.15 | 367470 | 3.37 | 108569 | 1.43 |
| P18S/Q62H/L79Q/F91S | 283357 | 1.89 | 324877 | 2.98 | 125541 | 1.65 |
| P18S/F91S | 222780 | 1.49 | 300049 | 2.75 | 48542 | 0.64 |
| P18L/V57T/T61S/S65Y/S67A/L104T | 278178 | 1.86 | 276870 | 2.54 | 121499 | 1.60 |
| P18T/T45Q | 326769 | 2.18 | 357515 | 3.28 | 92389 | 1.21 |
| T61M/S65W/S67A/L104T | 360915 | 2.41 | 417897 | 3.83 | 148954 | 1.96 |
| P18S/V41A/S42G/T45G/L104N | 3821 | 0.03 | 11449 | 0.10 | 3087 | 0.04 |
| P18H/S42G/T45I/S52T/G53R/S54H/V57L/H59E/T61S/S65D/E68G/L104N | 5066 | 0.03 | 177351 | 1.63 | 3700 | 0.05 |
| P18S/S42G/T45V/F58L/S67W/L104N | 14137 | 0.09 | 15175 | 0.14 | 15324 | 0.20 |
| P18S/T45I/L104N | 141745 | 0.95 | 298011 | 2.73 | 97246 | 1.28 |
| P18S/S42G/T45G/L104N/V106A | 29387 | 0.20 | 117965 | 1.08 | 15884 | 0.21 |
| P18H/H4OR/S42G/T45I/S52T/G53R/S54H/V57L/H59E/T61S/S65D/E68G/L104Y/V106L/F108H | 12335 | 0.08 | 14657 | 0.13 | 15779 | 0.21 |
| P18S/T45Q/L79P/L104T | 206674 | 1.38 | 285512 | 2.62 | 87790 | 1.15 |
| P18L/Q62R | 66939 | 0.45 | 25063 | 0.23 | 10928 | 0.14 |
| P18L/H49R/L104T/D116N | 167980 | 1.12 | 214677 | 1.97 | 62451 | 0.82 |
| S65T/L104T | 205942 | 1.38 | 187147 | 1.71 | 65207 | 0.86 |
| P18L/A47V/Q62Y/E73D/L104T | 146142 | 0.98 | 248926 | 2.28 | 73956 | 0.97 |
| P18L/S42P/T45Q/T61G/S65H/S67E/L104T/D116N | 153536 | 1.03 | 402503 | 3.69 | 53044 | 0.70 |
| T45Q/S52E/Q62F/L104E | 132850 | 0.89 | 276434 | 2.53 | 14558 | 0.19 |
| Wildtype CD 155 ECD-Fc | 149692 | 1.00 | 109137 | 1.00 | 76083 | 1.00 |
| Anti-human Fc PE | 2287 | 0.02 | 4799 | 0.04 | 2061 | 0.03 |

TABLE 20D

| Additional CD155 Variants and Binding Data. | | | | | | |
|---|---|---|---|---|---|---|
| | TIGIT | | CD226 | | CD96 | |
| CD155 Mutations | MFI at 100 nM | Fold Increase to WT IgV | MFI at 100 nM | Fold Increase to WT IgV | MFI at 100 nM | Fold Increase to WT IgV |
| P18F/T26M/L44V/Q62K/L79P/F91S/L104M/G111D | 117327 | 1.2 | 1613 | 0.1 | 1629 | 0.1 |
| P18S/T45S/T61K/S65W/S67A/F91S/G111R | 124936 | 1.3 | 2114 | 0.1 | 2223 | 0.1 |
| P18S/L79P/L104M/T107M | 110512 | 1.1 | 18337 | 0.9 | 22793 | 1.3 |

TABLE 20D-continued

| Additional CD155 Variants and Binding Data. | | | | | | |
|---|---|---|---|---|---|---|
| | TIGIT | | CD226 | | CD96 | |
| CD155 Mutations | MFI at 100 nM | Fold Increase to WT IgV | MFI at 100 nM | Fold Increase to WT IgV | MFI at 100 nM | Fold Increase to WT IgV |
| P18S/S65W/S67A/M90V/V95A/ L104Q/G111R | 101726 | 1.0 | 1605 | 0.1 | 2571 | 0.1 |
| Wildtype CD155-ECD | 98935 | 1.0 | 20029 | 1.0 | 17410 | 1.0 |

TABLE 20E

| Additional CD155 Variants and Binding Data. | | | | | | |
|---|---|---|---|---|---|---|
| | TIGIT | | CD226 | | CD96 | |
| CD155 Mutations | MFI at 11.1 nM | Fold Change from CD155-ECD | MFI at 11.1 nM | Fold Change from CD155-ECD | MFI at 11.1 nM | Fold Change from CD155-ECD |
| P18S/A47G/L79P/F91S/L104M/T107A/R113W | 56,409 | 1.19 | 1,191 | 0.08 | 25,362 | 1.49 |
| P18T/D23G/S24A/N35D/H49L/L79P/F91S/L104M/G111R | 128,536 | 2.72 | 987 | 0.06 | 3,497 | 0.20 |
| V9L/P18S/Q60R/V75L/L79P/R89K/F91S/L104E/G111R | 125,329 | 2.65 | 986 | 0.06 | 959 | 0.06 |
| P18S/H49R/E73D/L79P/N85D/F91S/V95A/L104M/G111R | Little to no protein produced | | | | | |
| V11A/P18S/L79P/F91S/L104M/G111R | 48,246 | 1.02 | 974 | 0.06 | 923 | 0.05 |
| V11A/P18S/S54R/Q60P/Q62K/L79P/N85D/F91S/T107M | 190,392 | 4.02 | 1,019 | 0.07 | 1,129 | 0.07 |
| P18T/S52P/S65A/S67V/L79P/F91S/L104M/G111R | 121,611 | 2.57 | 986 | 0.06 | 16,507 | 0.97 |
| P18T/M36T/L79P/F91S/G111R | 150,015 | 3.17 | 1,029 | 0.07 | 2,514 | 0.15 |
| D8G/P185/M36I/V38A/H49Q/A76E/F91S/L104M/T107A/R113W | 79,333 | 1.68 | 1,026 | 0.07 | 2,313 | 0.14 |
| P18S/S52P/S65A/S67V/L79P/F91S/L104M/T107S/R113W | 23,766 | 0.50 | 1,004 | 0.07 | 1,080 | 0.06 |
| T15I/P18T/L79P/F91S/L104M/G111R | 55,498 | 1.17 | 1,516 | 0.10 | 1,030 | 0.06 |
| P18F/T26M/L44V/Q62K/L79P/E82D/F91S/L104M/G111D | 213,640 | 4.51 | 991 | 0.06 | 1,276 | 0.07 |
| P18T/E37G/G53R/Q62K/L79P/F91S/E98D/L104M/T107M | 251,288 | 5.31 | 2,001 | 0.13 | 45,878 | 2.69 |
| P18L/K70E/L79P/F91S/V95A/G111R | 62,608 | 1.32 | 1,117 | 0.07 | 973 | 0.06 |
| V9I/Q12K/P18F/S65A/S67V/L79P/L104T/G111R/S112I | 81,932 | 1.73 | 803 | 0.05 | 68,295 | 4.00 |
| P18F/S65A/S67V/F91S/L104M/G111R | 30,661 | 0.65 | 901 | 0.06 | 3,193 | 0.19 |
| V9I/V10I/P18S/F20S/T45A/L79P/F91S/L104M/ F108Y/G111R/S112V | 151,489 | 3.20 | 973 | 0.06 | 974 | 0.06 |
| V9L/P18L/L79P/M90I/F91S/T102S/L104M/G111R | 155,279 | 3.28 | 910 | 0.06 | 10,568 | 0.62 |
| P18C/T26M/L44V/M55I/Q62K/L79P/F91S/L104M/T107M | 137,521 | 2.91 | 973 | 0.06 | 111,085 | 6.51 |
| V91/P18T/D23G/L79P/F91S/G111R | 151,426 | 3.20 | 897 | 0.06 | 2,725 | 0.16 |
| P18F/L79P/M90L/F91S/V95A/L104M/G111R | 125,639 | 2.66 | 917 | 0.06 | 3,939 | 0.23 |
| P18F/L79P/M90L/F91S/V95A/L104M/G111R | 115,156 | 2.43 | 1,073 | 0.07 | 2,464 | 0.14 |
| P18T/M36T/S65A/S67E/L79Q/A81T/F91S/G111R | 10,616 | 0.22 | 1,130 | 0.07 | 963 | 0.06 |
| V9L/P18T/Q62R/L79P/F91S/L104M/G111R | 195,111 | 4.12 | 835 | 0.05 | 1,497 | 0.09 |
| CD155-ECD-Fc | 47,319 | 1.00 | 15,421 | 1.00 | 17,067 | 1.00 |
| Fc Control | 2,298 | 0.05 | 1,133 | 0.07 | 996 | 0.06 |

TABLE 20F

| Additional CD155 Variants and Binding Data. | | | | | | | | |
|---|---|---|---|---|---|---|---|---|
| | TIGIT | | CD226 | | CD112R | | CD96 | |
| CD155 Mutations | MFI at 25 nM | Fold Change from CD155-ECD | MFI at 25 nM | Fold Change from CD155-ECD | MFI at 25 nM | Fold Change from CD155-ECD | MFI at 25 nM | Fold Change from CD155-ECD |
| P18T/G19D/M36T/S54N/L79P/ L83Q/F91S/T107M/F108Y | 905 | 0.02 | 748 | 0.02 | 1276 | 1.56 | 726 | 0.01 |
| V9L/P18L/M55V/S69L/L79P/ A81E/F91S/T107M | 58656 | 1.34 | 11166 | 0.29 | 920 | 1.13 | 67364 | 1.39 |
| P18F/H40Q/T61K/Q62K/L79P/ F91S/L104M/T107V | 108441 | 2.48 | 853 | 0.02 | 918 | 1.13 | 8035 | 0.17 |
| P18S/Q32R/Q62K/R78G/L79P/ F91S/T107A/R113W | 5772 | 0.13 | 701 | 0.02 | 843 | 1.03 | 831 | 0.02 |
| Q12H/P18T/L21S/G22S/V57A/ Q62R/L79P/F91S/T107M | 1084 | 0.02 | 687 | 0.02 | 876 | 1.07 | 818 | 0.02 |
| V9I/P18S/S24P/H49Q/F58Y/ Q60R/Q62K/L79P/F91S/T107M | 69926 | 1.60 | 1089 | 0.03 | 1026 | 1.26 | 43856 | 0.90 |
| P18T/W46C/H49R/S65A/S67V/ A76T/L79P/S87T/L104M | 918 | 0.02 | 640 | 0.02 | 803 | 0.98 | 717 | 0.01 |

TABLE 20F-continued

| Additional CD155 Variants and Binding Data. | | | | | | | | |
|---|---|---|---|---|---|---|---|---|
| | TIGIT | | CD226 | | CD112R | | CD96 | |
| CD155 Mutations | MFI at 25 nM | Fold Change from CD155-ECD | MFI at 25 nM | Fold Change from CD155-ECD | MFI at 25 nM | Fold Change from CD155-ECD | MFI at 25 nM | Fold Change from CD155-ECD |
| P18S/S42T/E51G/L79P/F91S/G92W/T107M | 12630 | 0.29 | 707 | 0.02 | 857 | 1.05 | 1050 | 0.02 |
| P18S/S42T/E51G/L79P/F91S/G92W/T107M | 7476 | 0.17 | 851 | 0.02 | 935 | 1.15 | 924 | 0.02 |
| V10F/T15S/P18L/R48Q/L79P/F91S/T107M/V115M | 1168 | 0.03 | 792 | 0.02 | 901 | 1.10 | 998 | 0.02 |
| P18S/L21M/Y30F/N35D/R84W/F91S/T107M/D116G | 1377 | 0.03 | 743 | 0.02 | 946 | 1.16 | 1033 | 0.02 |
| P18F/E51V/S54G/Q60R/L79Q/E82G/S87T/M901/F91S/G92R/T107M | 46090 | 1.05 | 15701 | 0.41 | 1012 | 1.24 | 61814 | 1.27 |
| Q16H/P18F/F91S/T107M | Little to no protein produced | | | | | | | |
| P18T/D23G/Q60R/S67L/L79P/F91S/T107M/V115A | 64091 | 1.47 | 30931 | 0.81 | 874 | 1.07 | 108875 | 2.24 |
| D8G/V9I/V11A/P18T/T26M/S52P/L79P/F91S/G92A/T107L/V115A | 52508 | 1.20 | 9483 | 0.25 | 817 | 1.00 | 97770 | 2.01 |
| V9I/P18F/A47E/G50S/E68G/L79P/F91S/T107M | 55167 | 1.26 | 54341 | 1.43 | 752 | 0.92 | 102115 | 2.10 |
| P18S/M55I/Q62K/S69P/L79P/F91S/T107M | Little to no protein produced | | | | | | | |
| P18T/T39S/S52P/S54R/L79P/F91S/T107M | 45927 | 1.05 | 744 | 0.02 | 1038 | 1.27 | 1225 | 0.03 |
| P18S/D23N/L79P/F91S/T107M/S114N | Little to no protein produced | | | | | | | |
| P18S/P34S/E51V/L79P/F91S/G111R | 7917 | 0.18 | 769 | 0.02 | 853 | 1.04 | 892 | 0.02 |
| P18S/H59N/V75A/L79P/A81T/F91S/L104M/T107M | 800 | 0.02 | 676 | 0.02 | 915 | 1.12 | 759 | 0.02 |
| P18S/W46R/E68D/L79P/F91S/T107M/R113G | 1359 | 0.03 | 717 | 0.02 | 798 | 0.98 | 737 | 0.02 |
| V9L/P18F/T45A/S65A/S67V/R78K/L79V/F91S/T107M/S114T | 130274 | 2.98 | 153569 | 4.04 | 812 | 1.00 | 85605 | 1.76 |
| P18T/M55L/T61R/L79P/F91S/V106I/T107M | 133399 | 3.05 | 1906 | 0.05 | 827 | 1.01 | 57927 | 1.19 |
| T15I/P18S/V33M/N35F/T39S/M55L/R785/L79P/F91S/T107M | 7550 | 0.17 | 1015 | 0.03 | 789 | 0.97 | 2709 | 0.06 |
| P18S/Q62K/K70E/L79P/F91S/G92E/R113W | 11173 | 0.26 | 691 | 0.02 | 735 | 0.90 | 1951 | 0.04 |
| P18F/F20I/T26M/A47V/E51K/L79P/F91S | 136088 | 3.11 | 54026 | 1.42 | 1401 | 1.72 | 96629 | 1.99 |
| P18T/D23A/Q60H/L79P/M90V/F91S/T107M | 43795 | 1.00 | 98241 | 2.58 | 888 | 1.09 | 70891 | 1.46 |
| P18S/D231G/C29R/N35D/E37G/M55I/Q62K/565A/567G/R78G/L79P/F91S/L104M/T107M/Q110R | 1599 | 0.04 | 1030 | 0.03 | 1115 | 1.37 | 1944 | 0.04 |
| A13E/P18S/M36R/Q62K/S67T/L79P/N85D/F91S/T107M | Little to no protein produced | | | | | | | |
| V9I/P18T/H49R/L79P/N85D/F91S/L104T/T107M | 46375 | 1.06 | 76851 | 2.02 | 794 | 0.97 | 80210 | 1.65 |
| V9A/P18F/T615/Q62L/L79P/F91S/G111R | 26109 | 0.60 | 891 | 0.02 | 825 | 1.01 | 2633 | 0.05 |
| D8E/P18T/T61A/L79P/F91S/T107M | Little to no protein produced | | | | | | | |
| P18S/V41A/H49R/S54C/L79S/N85Y/L88P/F91S/L104M/T107M | 1098 | 0.03 | 830 | 0.02 | 876 | 1.07 | 1678 | 0.03 |
| V11E/P18H/F20Y/V25E/N35S/H49R/L79P/F91S/T107M/G111R | 979 | 0.02 | 846 | 0.02 | 844 | 1.03 | 928 | 0.02 |
| V11A/P18F/D23A/L79P/G80D/V95A/T107M | 45249 | 1.04 | 913 | 0.02 | 830 | 1.02 | 33883 | 0.70 |
| P18S/K70R/L79P/F91S/G111R | 16180 | 0.37 | 793 | 0.02 | 854 | 1.05 | 1182 | 0.02 |
| P18T/D23A/Q60H/L79P/M90V/F91S/T107M | 175673 | 4.02 | 161958 | 4.26 | 879 | 1.08 | 50981 | 1.05 |
| V9L/V11M/P18S/N35S/S54G/Q62K/L79P/L104M/T107M/V115M | 2999 | 0.07 | 2315 | 0.06 | 893 | 1.09 | 925 | 0.02 |
| V9L/P18Y/V25A/V38G/M55V/A77T/L79P/M90I/F91S/L104M | 138011 | 3.16 | 26015 | 0.68 | 919 | 1.13 | 17970 | 0.37 |
| V10G/P18T/L72Q/L79P/F91S/T107M | 4253 | 0.10 | 1584 | 0.04 | 863 | 1.06 | 3643 | 0.07 |
| P18S/H59R/A76G/R78S/L79P | 130622 | 2.99 | 79435 | 2.09 | 1009 | 1.24 | 44493 | 0.91 |
| V9A/P18S/M36T/S65G/L79P/F91S/L104T/G111R/S112I | 92503 | 2.12 | 989 | 0.03 | 886 | 1.09 | 7850 | 0.16 |

TABLE 20F-continued

Additional CD155 Variants and Binding Data.

| CD155 Mutations | TIGIT MFI at 25 nM | TIGIT Fold Change from CD155-ECD | CD226 MFI at 25 nM | CD226 Fold Change from CD155-ECD | CD112R MFI at 25 nM | CD112R Fold Change from CD155-ECD | CD96 MFI at 25 nM | CD96 Fold Change from CD155-ECD |
|---|---|---|---|---|---|---|---|---|
| P18T/S52A/V57A/Q60R/Q62K/S65C/L79P/F91T/N100Y/T107M | 187338 | 4.29 | 10579 | 0.28 | 908 | 1.11 | 3791 | 0.08 |
| V11A/P18F/N35D/A47E/Q62K/L79P/F91S/G99D/T107M/S114N | Little to no protein produced | | | | | | | |
| V11A/P18T/N35S/L79P/S87T/F91S | 218660 | 5.00 | 273825 | 7.20 | 1269 | 1.56 | 69871 | 1.44 |
| V9D/V11M/Q12L/P18S/E37V/M55I/Q60R/K70Q/L79P/F91S/L104M/T107M | 8693 | 0.20 | 790 | 0.02 | 852 | 1.04 | 1991 | 0.04 |
| T15S/P18S/Y30H/Q32L/Q62R/L79P/F91S/T107M | 16213 | 0.37 | 2092 | 0.06 | 1056 | 1.29 | 6994 | 0.14 |
| CD155-ECD-Fc | 43704 | 1.00 | 38032 | 1.00 | 816 | 1.00 | 48638 | 1.00 |
| CD112-IgV | 1289 | | 824 | | 17819 | | 1172 | 0.02 |

TABLE 21A

Variant CD112 selected against cognate binding partners. Molecule sequences/binding data/and costimulatory bioactivity data.

| CD112 mutation(s) | TIGIT tfxn MFI (TIGIT MFI parental ratio) | CD112R tfxn MFI (CD112R MFI parental ratio) | CD226 MFI (CD226 MFI parental ratio) | Mock Expi293 MFI (Mock MFI parental ratio) | Anti-CD3 IFN-gamma (pg/mL) (Anti-CD3 IFN-gamma parental ratio) |
|---|---|---|---|---|---|
| WT CD112 | 210829 (1.00) | 1452 (1.00) | 265392 (1.00) | 1112 (1.00) | 676.6 (1.00) |
| Y33H/A112V/G117D | 12948 (0.06) | 1552 (1.07) | 1368 (0.01) | 1241 (1.12) | 164.8 (0.24) |
| V19A/Y33H/S64G/S80G/G98S/N106Y/A112V | 48356 (0.23) | 1709 (1.18) | 2831 (0.01) | 1098 (0.99) | |
| L32P/A112V | 191432 (0.91) | 1557 (1.07) | 11095 (0.04) | 1259 (1.13) | 390.4 (0.58) |
| A95V/A112I | 238418 (1.13) | 1706 (1.17) | 51944 (0.20) | 1215 (1.09) | 282.5 (0.42) |
| P28S/A112V | 251116 (1.19) | 1985 (1.37) | 153382 (0.58) | 1189 (1.07) | 503.4 (0.74) |
| P27A/T38N/V101A/A112V | 255803 (1.21) | 2138 (1.47) | 222822 (0.84) | 1399 (1.26) | 240.7 (0.36) |
| S118F | 11356 (0.05) | 5857 (4.03) | 6938 (0.03) | 1270 (1.14) | 271.7 (0.40) |
| R12W/H48Y/F54S/S118F | 10940 (0.05) | 3474 (2.39) | 5161 (0.02) | 1069 (0.96) | |
| R12W/Q79R/S118F | 2339 (0.01) | 7370 (5.08) | 1880 (0.01) | 1338 (1.20) | 447.4 (0.66) |
| T113S/S118Y | 6212 (0.03) | 6823 (4.70) | 1554 (0.01) | 1214 (1.09) | 225.1 (0.33) |
| S118Y | 2921 (0.01) | 6535 (4.50) | 2003 (0.01) | 1463 (1.32) | 190.4 (0.28) |
| N106I/S118Y | 2750 (0.01) | 7729 (5.32) | 1815 (0.01) | 1222 (1.10) | 265.8 (0.39) |
| N106I/S118F | 1841 (0.01) | 9944 (6.85) | 1529 (0.01) | 1308 (1.18) | 437.9 (0.65) |
| A95T/L96P/S118Y | 2352 (0.01) | 4493 (3.09) | 1412 (0.01) | 1329 (1.19) | 292.4 (0.43) |
| Y33H/P67S/N106Y/A112V | 225015 (1.07) | 3259 (2.24) | 204434 (0.77) | 1296 (1.17) | 618.8 (0.91) |
| N106Y/A112V | 6036 (0.03) | 1974 (1.36) | 15334 (0.06) | 1108 (1.00) | 409.9 (0.61) |
| T18S/Y33H/A112V | 252647 (1.20) | 1347 (0.93) | 183181 (0.69) | 1412 (1.27) | 601.8 (0.89) |
| P9S/Y33H/N47S/A112V | 240467 (1.14) | 1418 (0.98) | 203608 (0.77) | 1361 (1.22) | 449.1 (0.66) |
| P42S/P67H/A112V | 204484 (0.97) | 1610 (1.11) | 188647 (0.71) | 1174 (1.06) | 530.6 (0.78) |
| P27L/L32P/P42S/A112V | 219883 (1.04) | 1963 (1.35) | 84319 (0.32) | 1900 (1.71) | 251.6 (0.37) |
| G98D/A112V | 4879 (0.02) | 2369 (1.63) | 6100 (0.02) | 1729 (1.55) | 387.0 (0.57) |
| Y33H/S35P/N106Y/A112V | 250724 (1.19) | 1715 (1.18) | 94373 (0.36) | 1495 (1.34) | 516.2 (0.76) |
| L32P/P42S/T100A/A112V | 242675 (1.15) | 1742 (1.20) | 202567 (0.76) | 1748 (1.57) | 435.3 (0.64) |
| P27S/P45S/N106I/A112V | 223557 (1.06) | 1799 (1.24) | 84836 (0.32) | 1574 (1.42) | 277.5 (0.41) |
| Y33H/N47K/A112V | 251339 (1.19) | 1525 (1.05) | 199601 (0.75) | 1325 (1.19) | 483.2 (0.71) |
| Y33H/N106Y/A112V | 297169 (1.41) | 1782 (1.23) | 258315 (0.97) | 1440 (1.30) | 485.4 (0.72) |
| K78R/D84G/A112V/F114S | 236662 (1.12) | 1638 (1.13) | 24850 (0.09) | 1345 (1.21) | 142.5 (0.21) |
| Y33H/N47K/F54L/A112V | 14483 (0.07) | 1617 (1.11) | 2371 (0.01) | 1353 (1.22) | 352.8 (0.52) |
| Y33H/A112V | 98954 (0.47) | 1216 (0.84) | 1726 (0.01) | 1298 (1.17) | |
| A95V/A112V | 168521 (0.80) | 2021 (1.39) | 200789 (0.76) | 1459 (1.31) | 412.9 (0.61) |
| R12W/A112V | 135635 (0.64) | 1582 (1.09) | 23378 (0.09) | 1412 (1.27) | 165.8 (0.24) |
| A112V | 213576 (1.01) | 1986 (1.37) | 151900 (0.57) | 1409 (1.27) | 211.4 (0.31) |
| Y33H/A112V | 250667 (1.19) | 1628 (1.12) | 230578 (0.87) | 1216 (1.09) | 612.7 (0.91) |
| R12W/P27S/A112V | 3653 (0.02) | 1308 (0.90) | 9105 (0.03) | 1051 (0.94) | |
| Y33H/V51M/A112V | 218698 (1.04) | 1384 (0.95) | 195450 (0.74) | 1170 (1.05) | 709.4 (1.05) |
| Y33H/A112V/S118T | 219384 (1.04) | 1566 (1.08) | 192645 (0.73) | 1313 (1.18) | 396.3 (0.59) |
| Y33H/V101A/A112V/P115S | 5605 (0.03) | 1582 (1.09) | 5079 (0.02) | 1197 (1.08) | |
| H24R/T38N/D43G/A112V | 227095 (1.08) | 1537 (1.06) | 229311 (0.86) | 1336 (1.20) | 858.6 (1.27) |
| A112V | 4056 (0.02) | 1356 (0.93) | 10365 (0.04) | 986 (0.89) | |
| P27A/A112V | 193537 (0.92) | 1531 (1.05) | 230708 (0.87) | 3084 (2.77) | 355.1 (0.52) |
| A112V/S118T | 233173 (1.11) | 1659 (1.14) | 121817 (0.46) | 845 (0.76) | 533.3 (0.79) |
| R12W/A112V/M122I | 235935 (1.12) | 1463 (1.01) | 217748 (0.82) | 1350 (1.21) | 528.0 (0.78) |

TABLE 21A-continued

Variant CD112 selected against cognate binding partners. Molecule sequences/binding data/and costimulatory bioactivity data.

| CD112 mutation(s) | TIGIT tfxn MFI (TIGIT MFI parental ratio) | CD112R tfxn MFI (CD112R MFI parental ratio) | CD226 MFI (CD226 MFI parental ratio) | Mock Expi293 MFI (Mock MFI parental ratio) | Anti-CD3 IFN-gamma (pg/mL) (Anti-CD3 IFN-gamma parental ratio) |
|---|---|---|---|---|---|
| Q83K/N106Y/A112V | 205948 (0.98) | 2042 (1.41) | 234958 (0.89) | 1551 (1.39) | 481.4 (0.71) |
| R12W/P27S/A112V/S118T | 11985 (0.06) | 2667 (1.84) | 12756 (0.05) | 1257 (1.13) | 334.4 (0.49) |
| P28S/Y33H/A112V | 4711 (0.02) | 1412 (0.97) | 3968 (0.01) | 955 (0.86) | |
| P27S/Q90R/A112V | 3295 (0.02) | 1338 (0.92) | 6755 (0.03) | 1048 (0.94) | |
| L15V/P27A/A112V/S118T | 209888 (1.00) | 1489 (1.03) | 84224 (0.32) | 1251 (1.13) | 512.3 0.76) |
| Y33H/N106Y/T108I/A112V | | | Not tested | | |
| Y33H/P56L/V75M/V101M/A112V | | | Not tested | | |

TABLE 21B

Additional CD112 Variants and Binding Data.

| | TIGIT | | CD226 | | CD112R | | CD96 | |
|---|---|---|---|---|---|---|---|---|
| CD112 Mutation(s) | MFI 100 nM | Fold Increase to WT IgV | MFI at 100 nM | Fold Increase to WT IgV | MFI at 100 nM | Fold Increase to WT IgV | MFI at 100 nM | Fold Increase to WT IgV |
| S118F | 1763 | 0.02 | 1645 | 0.08 | 2974 | 0.61 | 1659 | 0.19 |
| N47K/Q79R/S118F | 1738 | 0.02 | 1689 | 0.09 | 2637 | 0.54 | 1647 | 0.19 |
| Q40R/P60T/A112V/S118T | 4980 | 0.06 | 1608 | 0.08 | 2399 | 0.50 | 2724 | 0.32 |
| F114Y/S118F | 110506 | 1.34 | 7325 | 0.37 | 1502 | 0.31 | 1553 | 0.18 |
| N106I/S118Y | 1981 | 0.02 | 1700 | 0.09 | 2394 | 0.49 | 1582 | 0.19 |
| S118Y | 101296 | 1.23 | 9990 | 0.50 | 1429 | 0.30 | 1551 | 0.18 |
| Y33H/K78R/S118Y | 2276 | 0.03 | 2115 | 0.11 | 3429 | 0.71 | 2082 | 0.24 |
| N106I/S118F | 1875 | 0.02 | 1675 | 0.08 | 2365 | 0.49 | 1662 | 0.19 |
| R12W/A46T/K66M/Q79R/ N106I/T113A/S118F | 3357 | 0.04 | 1808 | 0.09 | 1664 | 0.34 | 4057 | 0.48 |
| Y33H/A112V/S118F | 3376 | 0.04 | 2886 | 0.15 | 3574 | 0.74 | 3685 | 0.43 |
| R12W/Y33H/N106I/S118F | 100624 | 1.22 | 24513 | 1.24 | 1490 | 0.31 | 2060 | 0.24 |
| L15V/Q90R/S118F | 5791 | 0.07 | 4169 | 0.21 | 2752 | 0.57 | 4458 | 0.52 |
| N47K/D84G/N106I/S118Y | 3334 | 0.04 | 2819 | 0.14 | 2528 | 0.52 | 3498 | 0.41 |
| L32P/S118F | 3881 | 0.05 | 2506 | 0.13 | 2659 | 0.55 | 2518 | 0.29 |
| Y33H/Q79R/A112V/S118Y | | | | Low to no protein produced | | | | |
| T18A/N106I/S118T | 84035 | 1.02 | 10208 | 0.52 | 1585 | 0.33 | 1590 | 0.19 |
| L15V/Y33H/N106Y/A112V/S118F | | | | Low to no protein produced | | | | |
| V37M/S118F | 96986 | 1.18 | 2523 | 0.13 | 1985 | 0.41 | 1849 | 0.22 |
| N47K/A112V/S118Y | 1980 | 0.02 | 1859 | 0.09 | 2733 | 0.56 | 1825 | 0.21 |
| A46T/A112V | 4224 | 0.05 | 4685 | 0.24 | 3288 | 0.68 | 4273 | 0.50 |
| P28S/Y33H/N106I/S118Y | 6094 | 0.07 | 2181 | 0.11 | 1891 | 0.39 | 3021 | 0.35 |
| P30S/Y33H/N47K/V75M/ Q79R/N106I/S118Y | 2247 | 0.03 | 2044 | 0.10 | 1796 | 0.37 | 2658 | 0.31 |
| V19A/N47K/N106Y/K116E/S118Y | 2504 | 0.03 | 2395 | 0.12 | 2174 | 0.45 | 2852 | 0.33 |
| Q79R/T85A/A112V/S118Y | 2192 | 0.03 | 1741 | 0.09 | 2367 | 0.49 | 1620 | 0.19 |
| Y33H/A112V | 20646 | 0.25 | 1465 | 0.07 | 1794 | 0.37 | 2589 | 0.30 |
| V101M/N106I/S118Y | 55274 | 0.67 | 6625 | 0.33 | 1357 | 0.28 | 1494 | 0.17 |
| Y33H/Q79R/N106I/A112V/S118T | 6095 | 0.07 | 1760 | 0.09 | 2393 | 0.49 | 3033 | 0.36 |
| Q79R/A112V | 1571 | 0.02 | 1490 | 0.08 | 2284 | 0.47 | 1326 | 0.16 |
| Y33H/A46T/Q79R/N106I/S118F | 90813 | 1.10 | 15626 | 0.79 | 1298 | 0.27 | 3571 | 0.42 |
| A112V/G121S | 95674 | 1.16 | 19992 | 1.01 | 1252 | 0.26 | 4005 | 0.47 |
| Y33H/Q79R/N106I/S118Y | 36246 | 0.44 | 2118 | 0.11 | 1970 | 0.41 | 3250 | 0.38 |
| Y33H/N106I/A112V | 47352 | 0.57 | 4217 | 0.21 | 2641 | 0.55 | 1488 | 0.17 |
| Y33H/A46T/V101M/A112V/5118T | 14413 | 0.17 | 1596 | 0.08 | 2335 | 0.48 | 1441 | 0.17 |
| L32P/L99M/N106I/S118F | 3056 | 0.04 | 1791 | 0.09 | 2210 | 0.46 | 2000 | 0.23 |
| L32P/T108A/S118F | 104685 | 1.27 | 4531 | 0.23 | 2308 | 0.48 | 1518 | 0.18 |
| A112V | 4937 | 0.06 | 1903 | 0.10 | 1646 | 0.34 | 3011 | 0.35 |
| R12W/Q79R/A112V | 55539 | 0.67 | 6918 | 0.35 | 1386 | 0.29 | 1740 | 0.20 |
| Y33H/N106Y/E110G/A112V | 2786 | 0.03 | 2517 | 0.13 | 1787 | 0.37 | 2023 | 0.24 |
| Y33H/N106I/S118Y | 1967 | 0.02 | 1579 | 0.08 | 2601 | 0.54 | 1517 | 0.18 |
| Q79R/S118F | 82055 | 1.00 | 7582 | 0.38 | 1298 | 0.27 | 1970 | 0.23 |
| Y33H/Q79R/G98D/V101M/A112V | 21940 | 0.27 | 1632 | 0.08 | 1141 | 0.24 | 18423 | 2.16 |
| N47K/T81S/V101M/A112V/S118F | 6889 | 0.08 | 1311 | 0.07 | 1303 | 0.27 | 1145 | 0.13 |
| G825/S118Y | 4267 | 0.05 | 1938 | 0.10 | 2140 | 0.44 | 2812 | 0.33 |
| Y33H/A112V/S118Y | 14450 | 0.18 | 1532 | 0.08 | 2353 | 0.49 | 3004 | 0.35 |
| Y33H/N47K/Q79R/N106Y/A112V | 70440 | 0.85 | 3557 | 0.18 | 1447 | 0.30 | 1679 | 0.20 |
| Y33H/S118T | 113896 | 1.38 | 17724 | 0.89 | 1252 | 0.26 | 5001 | 0.59 |

TABLE 21B-continued

Additional CD112 Variants and Binding Data.

| CD112 Mutation(s) | TIGIT MFI 100 nM | TIGIT Fold Increase to WT IgV | CD226 MFI at 100 nM | CD226 Fold Increase to WT IgV | CD112R MFI at 100 nM | CD112R Fold Increase to WT IgV | CD96 MFI at 100 nM | CD96 Fold Increase to WT IgV |
|---|---|---|---|---|---|---|---|---|
| R12W/Y33H/Q79R/V101M/A112V | 3376 | 0.04 | 2727 | 0.14 | 2047 | 0.42 | 2339 | 0.27 |
| S118F | 2685 | 0.03 | 1864 | 0.09 | 2520 | 0.52 | 1566 | 0.18 |
| Wildtype CD112-IgV Fc | 82414 | 1.00 | 19803 | 1.00 | 4842 | 1.00 | 8541 | 1.00 |
| CD112 ECD-Fc | 29157 | 0.35 | 8755 | 0.44 | 1107 | 0.23 | 1103 | 0.13 |
| Anti-hFc PE | 1383 | 0.02 | 1461 | 0.07 | 1358 | 0.28 | 1468 | 0.17 |

TABLE 21C

Additional CD112 Variants and Binding Data.

| CD112 Mutation(s) | TIGIT MFI 100 nM | TIGIT Fold Increase to WT IgV | CD226 MFI at 100 nM | CD226 Fold Increase to WT IgV | CD112R MFI at 100 nM | CD112R Fold Increase to WT IgV | CD96 MFI at 100 nM | CD96 Fold Increase to WT IgV |
|---|---|---|---|---|---|---|---|---|
| N106I/S118Y | 1288 | 0.04 | 1334 | 0.12 | 6920 | 4.16 | 1102 | 0.44 |
| Y33H/Q83K/A112V/S118T | 115690 | 3.31 | 10046 | 0.93 | 1128 | 0.68 | 2053 | 0.82 |
| R12W/Q79R/S118F | 1436 | 0.04 | 1296 | 0.12 | 6546 | 3.93 | 1046 | 0.42 |
| V29M/Y33H/N106I/S118F | Not tested | | | | | | | |
| Y33H/A46T/A112V | 111256 | 3.18 | 14974 | 1.39 | 1148 | 0.69 | 3333 | 1.34 |
| Y33H/Q79R/S118F | 1483 | 0.04 | 1326 | 0.12 | 7425 | 4.46 | 1138 | 0.46 |
| Y33H/N47K/F74L/S118F | 1338 | 0.04 | 1159 | 0.11 | 1516 | 0.91 | 1140 | 0.46 |
| R12W/V101M/N106I/S118Y | 1378 | 0.04 | 1249 | 0.12 | 5980 | 3.59 | 1182 | 0.47 |
| A46T/V101A/N106I/S118Y | 1359 | 0.04 | 1199 | 0.11 | 6729 | 4.04 | 1173 | 0.47 |
| Y33H/N106Y/A112V | 113580 | 3.25 | 17771 | 1.65 | 1207 | 0.72 | 2476 | 0.99 |
| N106Y/A112V/S118T | Not tested | | | | | | | |
| S76P/T81I/V101M/N106Y/A112V/S118F | Not tested | | | | | | | |
| N106Y/A112V | 29015 | 0.83 | 2760 | 0.26 | 1159 | 0.70 | 1639 | 0.66 |
| P9R/L21V/P22L/I34M/S69F/F74L/A87V/A112V/L125A | 1920 | 0.05 | 1218 | 0.11 | 1107 | 0.66 | 1074 | 0.43 |
| Y33H/V101M/A112V | 126266 | 3.61 | 24408 | 2.27 | 1150 | 0.69 | 4535 | 1.82 |
| N106I/S118F | 1776 | 0.05 | 1385 | 0.13 | 9058 | 5.44 | 1370 | 0.55 |
| V29A/L32P/S118F | 1265 | 0.04 | 1148 | 0.11 | 5057 | 3.04 | 1194 | 0.48 |
| A112V | 69673 | 1.99 | 6387 | 0.59 | 1140 | 0.68 | 1214 | 0.49 |
| Y33H/V101M/A112V | 133815 | 3.83 | 24992 | 2.32 | 1184 | 0.71 | 6338 | 2.54 |
| P28S/Y33H/N106I/S118Y | 2745 | 0.08 | 1689 | 0.16 | 6625 | 3.98 | 1978 | 0.79 |
| Y33H/V101M/N106I/A112V | 118654 | 3.40 | 21828 | 2.03 | 1253 | 0.75 | 3871 | 1.55 |
| R12W/Y33H/N47K/Q79R/S118Y | 171390 | 4.91 | 5077 | 0.47 | 1124 | 0.68 | 2636 | 1.06 |
| A112V/S118T | 103203 | 2.95 | 15076 | 1.40 | 1155 | 0.69 | 1426 | 0.57 |
| Y33H/A46T/A112V/S118T | 141859 | 4.06 | 29436 | 2.74 | 1184 | 0.71 | 5760 | 2.31 |
| Y33H/A112V/F114L/S118T | 5161 | 0.15 | 1734 | 0.16 | 1184 | 0.71 | 1249 | 0.50 |
| A112V | 78902 | 2.26 | 6224 | 0.58 | 1114 | 0.67 | 1181 | 0.47 |
| Y33H/T38A/A46T/V101M/A112V | 111293 | 3.19 | 25702 | 2.39 | 1192 | 0.72 | 99015 | 39.69 |
| Q79R/A112V | 96674 | 2.77 | 7264 | 0.67 | 1130 | 0.68 | 1216 | 0.49 |
| Y33H/N106I/S118Y | 5720 | 0.16 | 1453 | 0.14 | 6543 | 3.93 | 1248 | 0.50 |
| P285/Y33H/569P/N106I/A112V/S118Y | 22393 | 0.64 | 1378 | 0.13 | 1550 | 0.93 | 19174 | 7.68 |
| Y33H/P42L/N47K/V101M/A112V | 214116 | 6.13 | 13878 | 1.29 | 1315 | 0.79 | 4753 | 1.91 |
| Y33H/N47K/F745/Q83K/N106I/F111L/A112V/S118T | 6719 | 0.19 | 1319 | 0.12 | 1305 | 0.78 | 1278 | 0.51 |
| Y33H/A112V/S118T/V119A | 184794 | 5.29 | 10204 | 0.95 | 1269 | 0.76 | 4321 | 1.73 |
| Y33H/N106I/A112V/S118F | 6872 | 0.20 | 1591 | 0.15 | 2308 | 1.39 | 2796 | 1.12 |
| Y33H/K66M/S118F/W124L | 1724 | 0.05 | 1259 | 0.12 | 6782 | 4.07 | 1197 | 0.48 |
| S118F | 1325 | 0.04 | 1213 | 0.11 | 7029 | 4.22 | 1135 | 0.46 |
| N106I/A112V | 111342 | 3.19 | 4241 | 0.39 | 1546 | 0.93 | 1178 | 0.47 |
| Y33H/A112V | 177926 | 5.09 | 13761 | 1.28 | 1152 | 0.69 | 3117 | 1.25 |
| WT CD112 IgV | 34932 | 1.00 | 10762 | 1.00 | 1665 | 1.00 | 2495 | 1.00 |
| WT CD112-Fc ECD | 28277 | 0.81 | 8023 | 0.75 | 1253 | 0.75 | 1064 | 0.43 |
| Anti-huFc PE | 1138 | 0.03 | 1006 | 0.09 | 1010 | 0.61 | 1062 | 0.43 |

TABLE 22A

Selected PD-L1 variants and binding data.

| PD-L1 Mutation(s) | Binding to Jurkat/PD-1 Cells: MFI at 50 nM | Binding to Jurkat/PD-1 Cells: Fold increase over wildtype PD-L1 IgV-Fc |
|---|---|---|
| K28N/M41V/N45T/H51N/K57E | 12585 | 2.4 |
| I20L/I36T/N45D/I47T | 3119 | 0.6 |
| I20L/M41K/K44E | 9206 | 1.8 |
| P6S/N45T/N78I/I83T | 419 | 0.1 |
| N78I | 2249 | 0.4 |
| M41K/N78I | Little or no protein produced | |
| N17D/N45T/V50A/D72G | Little or no protein produced | |
| I20L/F49S | Little or no protein produced | |
| N45T/V50A | 23887 | 4.6 |
| I20L/N45T/N78I | 29104 | 5.6 |
| N45T/N78I | 24865 | 4.7 |
| I20L/N45T | 24279 | 4.6 |
| I20L/N45T/V50A | 34158 | 6.5 |
| N45T | 6687 | 1.3 |
| M41K | 5079 | 1.0 |
| M41V/N45T | Little or no protein produced | |
| M41K/N45T | Little or no protein produced | |
| A33D/S75P/D85E | 685 | 0.1 |
| M18I/M41K/D43G/H51R/N78I | 20731 | 4.0 |
| V11E/I20L/I36T/N45D/H60R/S75P | 3313 | 0.6 |
| A33D/V50A | Little or no protein produced | |
| S16G/A33D/K71E/S75P | Little or no protein produced | |
| E27G/N45T/M97I | 881 | 0.2 |
| E27G/N45T/K57R | 5022 | 1.0 |
| A33D/E53V | 650 | 0.1 |
| D43G/N45D/V58A | 63960 | 12.2 |
| E40G/D43V/N45T/V50A | 809 | 0.2 |
| Y14S/K28E/N45T | 16232 | 3.1 |
| A33D/N78S | 1725 | 0.3 |
| A33D/N78I | 8482 | 1.6 |
| A33D/N45T | 17220 | 3.3 |
| A33D, N45T/N78I | Little or no protein produced | |
| E27G/N45T/V50A | 25267 | 4.8 |
| N45T/V50A/N78S | 28572 | 5.4 |
| N45T/V50A | 18717 | 3.6 |
| I20L/N45T/V110M | 464 | 0.1 |
| I20L/I36T/N45T/V50A | 7658 | 1.5 |
| N45T/L74P/S75P | 5251 | 1.0 |
| N45T/S75P | 12200 | 2.3 |
| S75P/K106R | 388 | 0.1 |
| S75P | 1230 | 0.2 |
| A33D/S75P | 306 | 0.1 |
| A33D/S75P/D104G | 251 | 0.0 |
| A33D/S75P | 1786 | 0.3 |
| I20L/E27G/N45T/V50A | 29843 | 5.7 |
| I20L/E27G/D43G/N45D/V58A/N78I | 69486 | 13.3 |
| I20L/D43G/N45D/V58A/N78I | 72738 | 13.9 |
| I20L/A33D/D43G/N45D/V58A/N78I | 80205 | 15.3 |
| I20L/D43G/N45D/N78I | 67018 | 12.8 |
| E27G/N45T/V50A/N78I | 30677 | 5.9 |
| N45T/V50A/N78I | 32165 | 6.1 |
| V11A/I20L/E27G/D43G/N45D/H51Y/S99G | 73727 | 14.1 |
| I20L/E27G/D43G/N45T/V50A | 36739 | 7.0 |
| I20L/K28E/D43G/N45D/V58A/Q89R, | 80549 | 15.4 |
| I20L/I36T/N45D | 16870 | 3.2 |
| I20L/K28E/D43G/N45D/E53G/V58A/N78I | 139 | 0.0 |
| A33D/D43G/N45D/V58A/S75P | 58484 | 11.2 |
| K23R/D43G/N45D | 67559 | 12.9 |
| I20L/D43G/N45D/V58A/N78I/D90G/G101D | 259 | 0.0 |
| D43G/N45D/L56Q/V58A/G101G-ins | 88277 | 16.8 |
| I20L/K23E/D43G/N45D/V58A/N78I | 89608 | 17.1 |
| I20L/K23E/D43G/N45D/V50A/N78I | 88829 | 16.9 |
| T19I/E27G/N45I/V50A/N78I/M97K | 25496 | 4.9 |
| I20L/M41K/D43G/N45D | 599 | 0.1 |
| K23R/N45T/N78I | 84980 | 16.2 |
| Full length PD-L1 Fc | 18465 | 3.5 |
| Wild type PD-L1 IgV | 5243 | 1.0 |
| Anti-PD-1 monoclonal antibody (nivolumab) | 79787 | 15.2 |
| Human IgG | 198 | 0.0 |

TABLE 22B

Flow Binding to Cells Expressing PD-1 or CD80

| | PD-1 | | CD80 | |
|---|---|---|---|---|
| PD-L1 Mutation(s) | MFI at 20 nM | Fold Change Compared to WT PD-L1 | MFI at 20 nM | Fold Change Compared to WT PD-L1 |
| K57R/S99G | 2953 | 0.9 | 16253 | 121.3 |
| K57R/S99G/F189L | 1930 | 0.6 | 12906 | 96.3 |
| M18V/M97L/F193S/R195G/E200K/H202Q | 69 | 0.0 | 241 | 1.8 |
| I36S/M41K/M97L/K144Q/R195G/E200K/H202Q/L206F | 3498 | 1.1 | 68715 | 512.8 |
| C22R/Q65L/L124S/K144Q/R195G/E200N/H202Q/T221L | Little or no protein produced | | | |
| M18V/I98L/L124S/P198T/L206F | 2187 | 0.7 | 143 | 1.1 |
| S99G/N117S/I148V/K171R/R180S | Little or no protein produced | | | |
| I36T/M97L/A103V/Q155H | 120 | 0.0 | 128 | 1.0 |
| K28I/S99G | 830 | 0.3 | 693 | 5.2 |
| R195S | 3191 | 1.0 | 138 | 1.0 |
| A79T/S99G/T185A/R195G/E200K/H202Q/L206F | 1963 | 0.6 | 643 | 4.8 |
| K57R/S99G/L124S/K144Q | 2081 | 0.7 | 14106 | 105.3 |
| K57R/S99G/R195G | 2479 | 0.8 | 10955 | 81.8 |
| D55V/M97L/S99G | 11907 | 3.8 | 71242 | 531.7 |
| E27G/I36T/D55N/M97L/K111E | 1904 | 0.6 | 88724 | 662.1 |
| E54G/M97L/S99G | 8414 | 2.7 | 51905 | 387.4 |
| G15A/I36T/M97L/K111E/H202Q | 112 | 0.0 | 13530 | 101.0 |
| G15A/I36T/V129D | 114 | 0.0 | 136 | 1.0 |
| G15A/I36T/V129D/R195G | 125 | 0.0 | 134 | 1.0 |
| G15A/V129D | 2075 | 0.7 | 128 | 1.0 |
| I36S/M97L | 3459 | 1.1 | 44551 | 332.5 |
| I36T/D55N/M97L/K111E/A204T | 265 | 0.1 | 62697 | 467.9 |
| I36T/D55N/M97L/K111E/V129A/F173L | 393 | 0.1 | 72641 | 542.1 |
| I36T/D55S/M97L/K111E/I148V/R180S | 94 | 0.0 | 30704 | 229.1 |
| I36T/G52R/M97L/V112A/K144E/V175A/P198T | 81 | 0.0 | 149 | 1.1 |
| I36T/I46V/D55G/M97L/K106E/K144E/T185A/R195G | 69 | 0.0 | 190 | 1.4 |
| I36T/I83T/M97L/K144E/P198T | 62 | 0.0 | 6216 | 46.4 |
| I36T/M97L/K111E | Little or no protein produced | | | |
| I36T/M97L/K144E/P198T | 197 | 0.1 | 40989 | 305.9 |
| I36T/M97L/Q155H/F193S/N201Y | 69 | 0.0 | 1251 | 9.3 |
| I36T/M97L/V129D | 523 | 0.2 | 50905 | 379.9 |
| L35P/I36S/M97L/K111E | 190 | 0.1 | 155 | 1.2 |
| M18I/I36T/E53G/M97L/K144E/E199G/V207A | 104 | 0.0 | 47358 | 353.4 |
| M18T/I36T/D55N/M97L/K111E | 138 | 0.0 | 71440 | 533.1 |
| M18V/M97L/T176N/R195G | 1301 | 0.4 | 45300 | 338.1 |
| M97L/S99G | 12906 | 4.1 | 81630 | 609.2 |
| N17D/M97L/S99G | 10079 | 3.2 | 73249 | 546.6 |
| S99G/T185A/R195G/P198T | 2606 | 0.8 | 22062 | 164.6 |
| V129D/H202Q | 2001 | 0.6 | 219 | 1.6 |
| V129D/P198T | 3245 | 1.0 | 152 | 1.1 |
| V129D/T150A | 1941 | 0.6 | 142 | 1.1 |
| V93E/V129D | 1221 | 0.4 | 150 | 1.1 |
| Y10F/M18V/S99G/Q138R/T203A | 70 | 0.0 | 412 | 3.1 |
| WT PD-L1 (IgV + IgC) Fc | 3121 | 1.0 | 134 | 1.0 |
| CTLA4-Fc | 59 | N/A | 199670 | N/A |
| Anti-PD 1 mAb | 31482 | N/A | 134 | N/A |
| Fc Control | 59 | N/A | 132 | N/A |

TABLE 22C

Additional Affinity-Matured IgSF Domain-Containing Molecules

| PD-L1 Mutation(s) | PD-L1 Mutation(s) |
|---|---|
| N45D | N45D/G102D/R194W/R195G |
| K160M/R195G | N45D/G52V/Q121L/P198S |
| N45D/K144E | N45D/I148V/R195G/N201D |
| N45D/P198S | N45D/K111T/T183A/I188V |
| N45D/P198T | N45D/Q89R/F189S/P198S |
| N45D/R195G | N45D/S99G/C137R/V207A |
| N45D/R195S | N45D/T163I/K167R/R195G |
| N45D/S131F | N45D/T183A/T192S/R194G |
| N45D/V58D | N45D/V50A/I119T/K144E |

TABLE 22C-continued

Additional Affinity-Matured IgSF Domain-Containing Molecules

| PD-L1 Mutation(s) | PD-L1 Mutation(s) |
|---|---|
| V129D/R195S | T19A/N45D/K144E/R195G |
| I98T/F173Y/L196S | V11E/N45D/T130A/P198T |
| N45D/E134G/L213P | V26A/N45D/T163I/T185A |
| N45D/F173I/S177C | K23N/N45D/L124S/K167T/R195G |
| N45D/I148V/R195G | K23N/N45D/Q73R/T163I |
| N45D/K111T/R195G | K28E/N45D/W149R/S158G/P198T |
| N45D/N113Y/R195S | K28R/N45D/K57E/I98V/R195S |
| N45D/N165Y/E170G | K28R/N45D/V129D/T163N/R195T |
| N45D/Q89R/I98V | M41K/D43G/N45D/R64S/R195G |
| N45D/S131F/P198S | M41K/D43G/N45D/R64S/S99G |
| N45D/S75P/P198S | N45D/R68L/F173L/D197G/P198S |

TABLE 22C-continued

| Additional Affinity-Matured IgSF Domain-Containing Molecules | |
|---|---|
| PD-L1 Mutation(s) | PD-L1 Mutation(s) |
| N45D/V50A/R195T | N45D/V50A/I148V/R195G/N201D |
| E27D/N45D/T183A/I188V | M41K/D43G/K44E/N45D/R195G/N201D |
| F173Y/T183I/L196S/T203A | N45D/V50A/L124S/K144E/L179P/R195G |
| K23N/N45D/S75P/N120S | |

TABLE 23A

Variant PD-L2 selected against PD-1. Molecule sequence and binding data.

| | Binding to Jurkat/PD-1 Cells | | Fortebio binding to |
|---|---|---|---|
| PD-L2 mutation(s) | MFI at 50 nM | Fold increase over wildtype PD-L2 IgV-Fc | PD-1-Fc Response Units |
| H15Q | 15998 | 1.63 | 0.007 |
| N24D | 1414 | 0.14 | −0.039 |
| E44D | 2928 | 0.3 | −0.006 |
| V89D | 3361 | 0.34 | 0.005 |
| Q82R, V89D | 44977 | 4.57 | 1.111 |
| E59G, Q82R | 12667 | 1.29 | −0.028 |
| S39I, V89D | 26130 | 2.65 | 0.26 |
| S67L, V89D | 15991 | 1.62 | 0.608 |
| S67L, I85F | 529 | 0.05 | −0.005 |
| S67L, I86T | 6833 | 0.69 | 0.141 |
| H15Q, K65R | 13497 | 1.37 | −0.001 |
| H15Q, Q72H, V89D | 12629 | 1.28 | 0.718 |
| H15Q, S67L, R76G | 47201 | 4.8 | 0.418 |
| H15Q, R76G, I85F | 2941 | 0.3 | −0.038 |
| H15Q, T47A, Q82R | 65174 | 6.62 | 0.194 |
| H15Q, Q82R, V89D | 49652 | 5.04 | 1.198 |
| H15Q, C23S, I86T | 830 | 0.08 | −0.026 |
| H15Q, S39I, I86T | 1027 | 0.1 | 0.309 |
| H15Q, R76G, I85F | 1894 | 0.19 | −0.006 |
| E44D, V89D, W91R | 614 | 0.06 | −0.048 |
| I13V, S67L, V89D | 26200 | 2.66 | 1.42 |
| H15Q, S67L, I86T | 15952 | 1.62 | 0.988 |
| I13V, H15Q, S67L, I86T | 21570 | 2.19 | 1.391 |
| I13V, H15Q, E44D, V89D | 23958 | 2.43 | 1.399 |
| I13V, S39I, E44D, Q82R, V89D | 71423 | 7.26 | 0.697 |
| I13V, E44D, Q82R, V89D | 45191 | 4.59 | 1.283 |
| I13V, Q72H, R76G, I86T | 10429 | 1.06 | 0.733 |
| I13V, H15Q, R76G, I85F | 4736 | 0.48 | −0.04 |
| H15Q, S39I, R76G, V89D | Little or no protein produced | | |
| H15Q, S67L, R76G, I85F | 2869 | 0.29 | 0.025 |
| H15Q, T47A, Q72H, R76G, I86T | 32103 | 3.26 | 0.512 |
| H15Q, T47A, Q72H, R76G | 16500 | 1.68 | 0.327 |
| I13V, H15Q, T47A, Q72H, R76G | 73412 | 7.46 | 0.896 |
| H15Q, E44D, R76G, I85F | 2885 | 0.29 | −0.013 |
| H15Q, S39I, S67L, V89D | 45502 | 4.62 | 1.174 |
| H15Q, N32D, S67L, V89D | 25880 | 2.63 | 1.407 |
| N32D, S67L, V89D | 31753 | 3.23 | 1.155 |
| H15Q, S67L, Q72H, R76G, V89D | 40180 | 4.08 | 1.464 |
| H15Q, Q72H, Q74R, R76G, I86T | 4049 | 0.41 | 0.093 |
| G28V, Q72H, R76G, I86T | 5563 | 0.57 | 0.003 |
| I13V, H15Q, S39I, E44D, S67L | 63508 | 6.45 | 0.889 |
| E44D, S67L, Q72H, Q82R, V89D | 51467 | 5.23 | 1.061 |
| H15Q, V89D | 17672 | 1.8 | 0.31 |
| H15Q, T47A | 26578 | 2.7 | 0.016 |
| I13V, H15Q, Q82R | 76146 | 7.74 | 0.655 |
| I13V, H15Q, V89D | 28745 | 2.92 | 1.331 |
| I13V, S67L, Q82R, V89D | 58992 | 5.99 | 1.391 |
| I13V, H15Q, Q82R, V89D | 49523 | 5.03 | 1.419 |
| H15Q, V31M, S67L, Q82R, V89D | 67401 | 6.85 | 1.37 |
| I13V, H15Q, T47A, Q82R | 89126 | 9.05 | 0.652 |
| I13V, H15Q, V31A, N45S, Q82R, V89D | 68016 | 6.91 | 1.327 |
| H15Q, T47A, H69L, Q82R, V89D | 65598 | 6.66 | 1.44 |
| I13V, H15Q, T47A, H69L, R76G, V89D | 54340 | 5.52 | 1.719 |
| I12V, I13V, H15Q, T47A, Q82R, V89D | 61207 | 6.22 | 1.453 |
| I13V, H15Q, R76G, D77N, Q82R, V89D | 33079 | 3.36 | 0.065 |
| I13V, H15Q, T47A, R76G, V89D | 53668 | 5.45 | 1.596 |
| I13V, H15Q, T47A, Q82R, V89D | 63320 | 6.43 | 1.418 |
| I13V, H15Q, T47A, Q82R, V89D | 60980 | 6.2 | 1.448 |
| I13V, H15Q, I36V, T47A, S67L, V89D | 52835 | 5.37 | 1.627 |

TABLE 23A-continued

Variant PD-L2 selected against PD-1. Molecule sequence and binding data.

| PD-L2 mutation(s) | Binding to Jurkat/PD-1 Cells MFI at 50 nM | Fold increase over wildtype PD-L2 IgV-Fc | Fortebio binding to PD-1-Fc Response Units |
|---|---|---|---|
| H15Q, T47A, K65R, S67L, Q82R, V89D | 79692 | 8.1 | 1.453 |
| H15Q, L33P, T47A, S67L, P71S, V89D | 45726 | 4.65 | 1.467 |
| I13V, H15Q, Q72H, R76G, I86T | 24450 | 2.48 | 1.355 |
| H15Q, T47A, S67L, Q82R, V89D | 67962 | 6.9 | 1.479 |
| F2L, H15Q, D46E, T47A, Q72H, R76G, Q82R, V89D | 23039 | 2.34 | 1.045 |
| I13V, H15Q, L33F, T47A, Q82R, V89D | 62254 | 6.32 | 1.379 |
| H15Q, N24S, T47A, Q72H, R76G, V89D | 32077 | 3.26 | 0.4 |
| I13V, H15Q, E44V, T47A, Q82R, V89D | 61005 | 6.2 | 1.329 |
| H15Q, N18D, T47A, Q72H, V73A, R76G, I86T, V89D | 48317 | 4.91 | 0.475 |
| I13V, H15Q, T37A, E44D, S48C, S67L, Q82R, V89D | 47605 | 4.84 | 1.255 |
| H15Q, L33H, S67L, R76G, Q82R, V89D | 62326 | 6.33 | 1.507 |
| I13V, H15Q, T47A, Q72H, R76G, I86T | 49016 | 4.98 | 1.477 |
| H15Q, S39I, E44D, Q72H, V75G, R76G, Q82R, V89D | 43713 | 4.44 | 0.646 |
| H15Q, T47A, S67L, R76G, Q82R, V89D | 71897 | 7.3 | 1.539 |
| I13V, H15Q, T47A, S67L, Q72H, R76G, Q82R, V89D | 71755 | 7.29 | 1.536 |
| Wild Type PD-L2 IgV | 9843 | 1 | −0.024 |
| Full length ECD of PD-L2 | 2145 | 0.22 | 0.071 |
| Full length ECD of PD-L1 (R&D Systems) | 23769 | 2.41 | 1.263 |
| Anti-PD-1 monoclonal antibody (nivolumab) | 87002 | 8.84 | 0.899 |

TABLE 23B

Bioactivity Data of PD-L2 variants selected against PD-1 in MLR.

| PD-L2 mutation(s) | IFN gamma levels pg/mL | Fold increase over wildtype PD-L2 IgV-Fc |
|---|---|---|
| H15Q | 1817.1 | 1.32 |
| N24D | 1976.3 | 1.44 |
| E44D | 1499.4 | 1.09 |
| V89D | 1168.1 | 0.85 |
| Q82R, V89D | 1617 | 1.17 |
| E59G, Q82R | 1511.3 | 1.1 |
| S39I, V89D | 1314.5 | 0.95 |
| S67L, V89D | 1230.1 | 0.89 |
| S67L, I85F | 1281.9 | 0.93 |
| S67L, I86T | 1020.4 | 0.74 |
| H15Q, K65R | 1510.8 | 1.1 |
| H15Q, Q72H, V89D | 1272.2 | 0.92 |
| H15Q, S67L, R76G | 1426.2 | 1.04 |
| H15Q, R76G, I85F | 1725.7 | 1.25 |
| H15Q, T47A, Q82R | 1317.9 | 0.96 |
| H15Q, Q82R, V89D | 1081.2 | 0.79 |
| H15Q, C23S, I86T | 1847.2 | 1.34 |
| H15Q, S39I, I86T | 1415.2 | 1.03 |
| H15Q, R76G, I85F | 1437.8 | 1.04 |
| E44D, V89D, W91R | 1560.1 | 1.13 |
| I13V, S67L, V89D | 867.5 | 0.63 |
| H15Q, S67L, I86T | 1034.2 | 0.75 |
| I13V, H15Q, S67L, I86T | 1014.4 | 0.74 |
| I13V, H15Q, E44D, V89D | 1384.2 | 1.01 |
| I13V, S39I, E44D, Q82R, V89D | 935.6 | 0.68 |
| I13V, E44D, Q82R, V89D | 1009.5 | 0.73 |
| I13V, Q72H, R76G, I86T | 1953 | 1.42 |
| I13V, H15Q, R76G, I85F | 1528.5 | 1.11 |
| H15Q, S67L, R76G, I85F | 1318.7 | 0.96 |
| H15Q, T47A, Q72H, R76G, I86T | 1599.6 | 1.16 |
| H15Q, T47A, Q72H, R76G | 1462.5 | 1.06 |
| I13V, H15Q, T47A, Q72H, R76G | 1469.8 | 1.07 |
| H15Q, E44D, R76G, I85F | 1391.6 | 1.01 |
| H15Q, S39I, S67L, V89D | 1227 | 0.89 |
| H15Q, N32D, S67L, V89D | 1285.7 | 0.93 |
| N32D, S67L, V89D | 1194 | 0.87 |
| H15Q, S67L, Q72H, R76G, V89D | 1061.2 | 0.77 |
| H15Q, Q72H, Q74R, R76G, I86T | 933.8 | 0.68 |
| G28V, Q72H, R76G, I86T | 1781.6 | 1.29 |
| I13V, H15Q, S39I, E44D, S67L | 1256.9 | 0.91 |

TABLE 23B-continued

Bioactivity Data of PD-L2 variants selected against PD-1 in MLR.

| PD-L2 mutation(s) | IFN gamma levels pg/mL | Fold increase over wildtype PD-L2 IgV-Fc |
|---|---|---|
| E44D, S67L, Q72H, Q82R, V89D | 1281.4 | 0.93 |
| H15Q, V89D | 1495.4 | 1.09 |
| H15Q, T47A | 1637.2 | 1.19 |
| I13V, H15Q, Q82R | 1432.9 | 1.04 |
| I13V, H15Q, V89D | 1123 | 0.82 |
| I13V, S67L, Q82R, V89D | 1372.8 | 1 |
| I13V, H15Q, Q82R, V89D | 1596.6 | 1.16 |
| H15Q, V31M, S67L, Q82R, V89D | 1206.5 | 0.88 |
| I13V, H15Q, T47A, Q82R | 1703.3 | 1.24 |
| I13V, H15Q, V31A, N45S, Q82R, V89D | 1723.1 | 1.25 |
| H15Q, T47A, H69L, Q82R, V89D | 1732.5 | 1.26 |
| I13V, H15Q, T47A, H69L, R76G, V89D | 1075.5 | 0.78 |
| I12V, I13V, H15Q, T47A, Q82R, V89D | 1533.2 | 1.11 |
| I13V, H15Q, R76G, D77N, Q82R, V89D | 1187.9 | 0.86 |
| I13V, H15Q, T47A, R76G, V89D | 1253.7 | 0.91 |
| I13V, H15Q, T47A, Q82R, V89D | 1445.5 | 1.05 |
| I13V, H15Q, T47A, Q82R, V89D | 1737 | 1.26 |
| I13V, H15Q, I36V, T47A, S67L, V89D | 1357.4 | 0.99 |
| H15Q, T47A, K65R, S67L, Q82R, V89D | 1335.3 | 0.97 |
| H15Q, L33P, T47A, S67L, P71S, V89D | 1289.1 | 0.94 |
| I13V, H15Q, Q72H, R76G, I86T | 1221 | 0.89 |
| H15Q, T47A, S67L, Q82R, V89D | 1197.1 | 0.87 |
| F2L, H15Q, D46E, T47A, Q72H, R76G, Q82R, V89D | 1170.7 | 0.85 |
| I13V, H15Q, L33F, T47A, Q82R, V89D | 1468.4 | 1.07 |
| I13V, H15Q, T47A, E58G, S67L, Q82R, V89D | 836.1 | 0.61 |
| H15Q, N24S, T47A, Q72H, R76G, V89D | 1091.8 | 0.79 |
| I13V, H15Q, E44V, T47A, Q82R, V89D | 1270.5 | 0.92 |
| H15Q, N18D, T47A, Q72H, V73A, R76G, I86T, V89D | 1065.8 | 0.77 |
| I13V, H15Q, T37A, E44D, S48C, S67L, Q82R, V89D | 1751.7 | 1.27 |
| H15Q, L33H, S67L, R76G, Q82R, V89D | 1502 | 1.09 |
| I13V, H15Q, T47A, Q72H, R76G, I86T | 1088.1 | 0.79 |
| H15Q, S39I, E44D, Q72H, V75G, R76G, Q82R, V89D | 940.9 | 0.68 |
| H15Q, T47A, S67L, R76G, Q82R, V89D | 1097.8 | 0.8 |
| I13V, H15Q, T47A, S67L, Q72H, R76G, Q82R, V89D | 1559.6 | 1.13 |
| Wild Type PD-L2 IgV | 1376.8 | 1 |
| Full length ECD of PD-L2 | 1173.2 | 0.85 |
| Full length ECD of PD-L1 | 2190.9 | 1.59 |
| Nivolumab (anti-PD-1) | 418.9 | 0.3 |

Example 18

Figure 18:
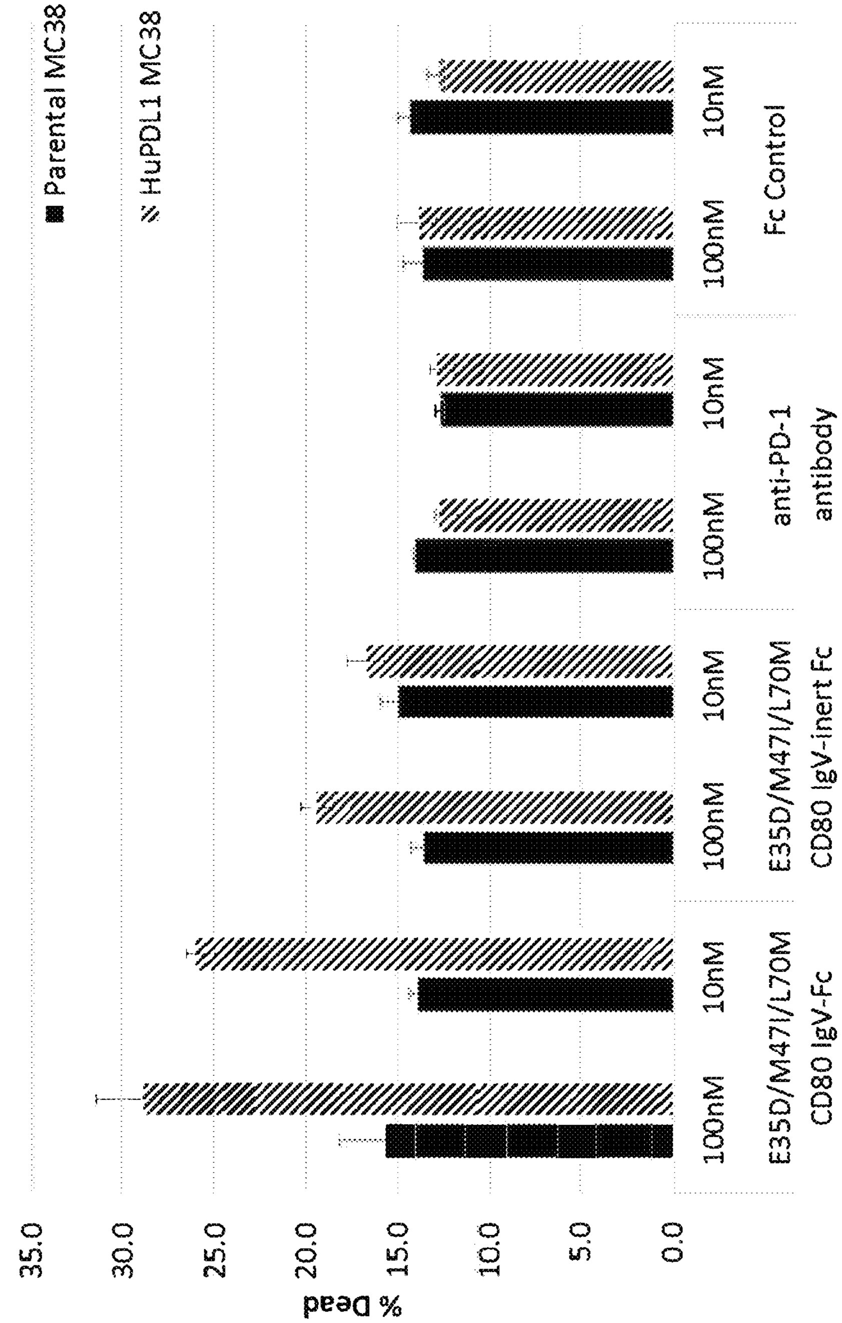
FIG. 18 depicts specific cytotoxic activity of CD80 IgV-Fc variants against huPD-L1 transduced MC38 tumor cells but not non-transduced parental MC38, demonstrating huPDL1 specific killing.

Cytotoxicity to HuPD-L1 Transduced MC38 Tumor Cells Compared to Anti-PD-L1 Antibody This Example describes the assessment of in vitro cytotoxicity of huPD-L1 transduced MC38 tumor cells. MC38 tumor cells, non-transduced or transduced with huPD-L1, were treated with Mitomycin-C and plated with human pan T cells labelled with CFSE at a1:5 ratio. Variant CD80 IgV-Fc, containing E35D/M47I/L70M (SEQ ID NO: 125), with either WT IgG1 Fc or an inert Fc were added to MC38 tumor cells at 100 nM or 10 nM and cultured with cells for 72 hours. As a control, an exemplary anti-PD-1 antibody nivolumab or an Fc (inert) only control also were assessed. Cells were then harvested and stained with 7-AAD viability dye. After acquiring samples on a flow cytometer, the percentage of dead cells was calculated using Flowjo analysis by gating on 7-AAD+ cells in the CFSE− gate. As shown in FIG. 18, increased cytotoxicity against huPD-L1 transduced MC38 tumor cells, but not non-transduced MC38 parental cells, was observed by exemplary assessed variant CD80 IgV-Fc molecules. In this assay, cytotoxic activity was not observed in the presence of the control anti-PD-1 antibody, indicating that the variant CD80 IgV Fc molecules exhibit improved activity compared to the anti-PD-1 antibody control.

Example 19

CD80 Variant Binding to Primary Human T Cells and Monocytes

Binding of exemplary variant CD80-IgV Fc molecules to primary CD28+ human CD4 T cells and human PD-L1+ monocytes was assessed. The exemplary variant CD80 IgV-Fc molecules that were assessed contained E35D/M47V/N48K/V68M/K89N (SEQ ID NO: 2250), H18Y/A26E/E35D/M47L/V68M/A71G/D90G (SEQ ID NO: 2276), E35D/D46V/M47L/V68M/L85Q/E88D (SEQ ID NO: 2280), and E35D/D46E/M47V/V68M/D90G/K93E (SEQ ID NO: 2284).

Figure 19A:
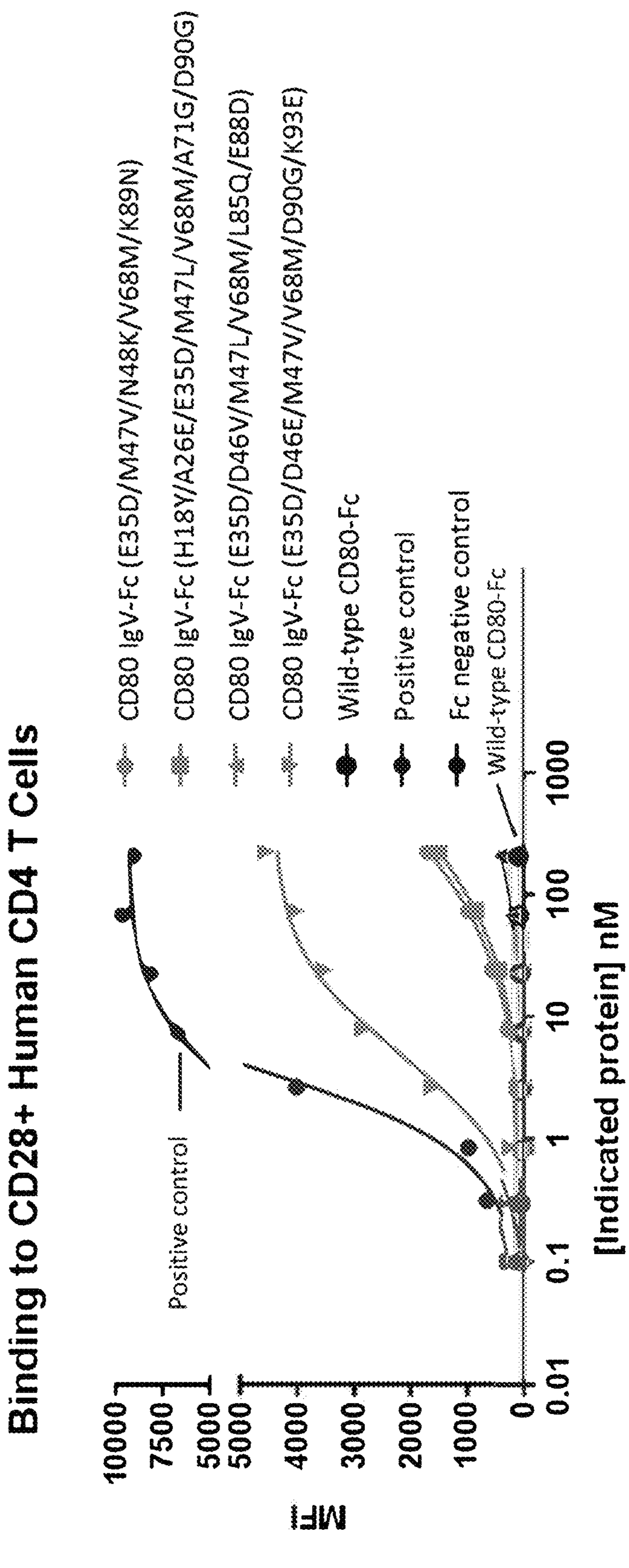
FIGS. 19A and B depict the binding of CD80 IgV-Fc variants to primary human T cells (A) and primary human monocytes (B).

Unactivated human pan T cells were incubated with various concentrations of variant CD80 IgV-Fc and then were stained with anti-CD4, anti-CD8 and anti-human IgG to detect the Fc portion of the CD80 IgV-Fc. As a control, binding of wild-type CD80 IgV-Fc, an Fc only negative control, and a CD28-binding ICOSL vIgD-Fc also was assessed. Binding was assessed by flow cytometry and MFI was determined using Flowjo analysis software. As shown in FIG. 19A, the tested variant CD80 IgV-Fc molecules demonstrated differential binding to primary human T cells, which, in some cases, was greater than wildtype CD80-IgV-Fc.

Figure 19B:
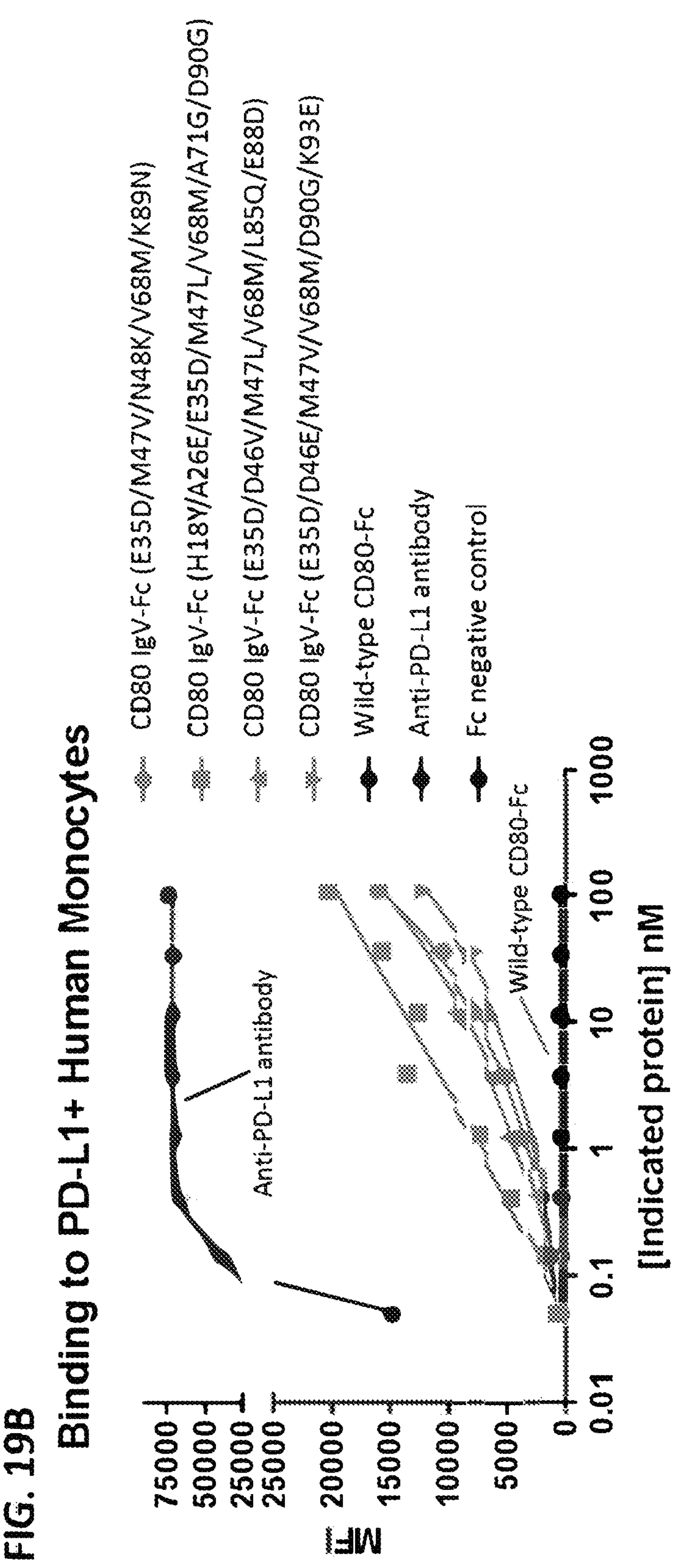

For binding to human monocyte-expressed PD-L1, human PBMC were plated overnight in the presence of anti-CD3 and anti-CD28. Cells were harvested the next day, incubated with various concentrations of variant CD80 IgV-Fc or an anti-PD-L1 antibody control (durvalumab), and then were stained with anti-CD14 to identify monocytes and anti-human IgG to detect the Fc portion of CD80 IgV molecules. Binding was assessed by flow cytometry and MFI was determined using Flowjo analysis software. As shown in FIG. 19B, all tested variant CD80 IgV-Fc molecules demonstrated substantially greater binding to primary human monocytes than wild-type CD80 IgV-Fc.

Example 20

Variant CD80 IgV-Fc Antagonism of PD-L1 Mediated PD-1 SHP2 Recruitment

This Example describes a Jurkat/PD-1/SHP2 Signaling Assay to assess the effect of the variant CD80 IgV-Fc molecules to antagonize the recruitment of the cytoplasmic protein tryrosine phosphatase SHP-2 to PD-1 by blocking PD-L1/PD-1 interaction. In an exemplary assay, a Jurkat cell line containing a recombinant β-galactosidase (β-gal) fragment Enzyme Donor (ED) tagged PD-1 receptor and an Enzyme Acceptor (EA) tagged SHP-2 domain were used (e.g. DiscoverX, USA; cat. 93-1106C19). In the assay, SHP-2 recruitment to PD-1 results in the EA and ED being in close proximity to allow complementation of the two enzyme fragments forming a functional beta-Gal enzyme that hydrolyzes a substrate to generate a chemiluminescent signal.

K562/OKT3/PD-L1 aAPC were pre-incubated with various concentrations of exemplary variant CD80 IgV-Fc (inert) for 30 minutes. The exemplary variant CD80 IgV-Fc molecules that were assessed contained H18Y/A26E/E35D/M47L/V68M/A71G/D90G (SEQ ID NO: 2276), E35D/M47V/N48K/V68M/K89N (SEQ ID NO: 2250), E35D/D46V/M47L/V68M/L85Q/E88D (SEQ ID NO: 2280), and E35D/D46E/M47V/V68M/D90G/K93E (SEQ ID NO: 2284). As a control, wild-type CD80 IgV-Fc (inert), an anti-PD-L1 antibody, and an Fc (inert) only control were also assessed. Jurkat/PD-1/SHP2 cells (DiscoverX Pathhunter Enzyme Complementation Fragment Recruitment line) were added and cells were incubated for 2 hours. The substrate for beta-Gal (DiscoverX Bioassay Detection reagent) was added to the wells, incubated for 1 hour at room temperature in the dark, and the luciferase was measured on a microplate reader (BioTek Cytation).

Figure 20:
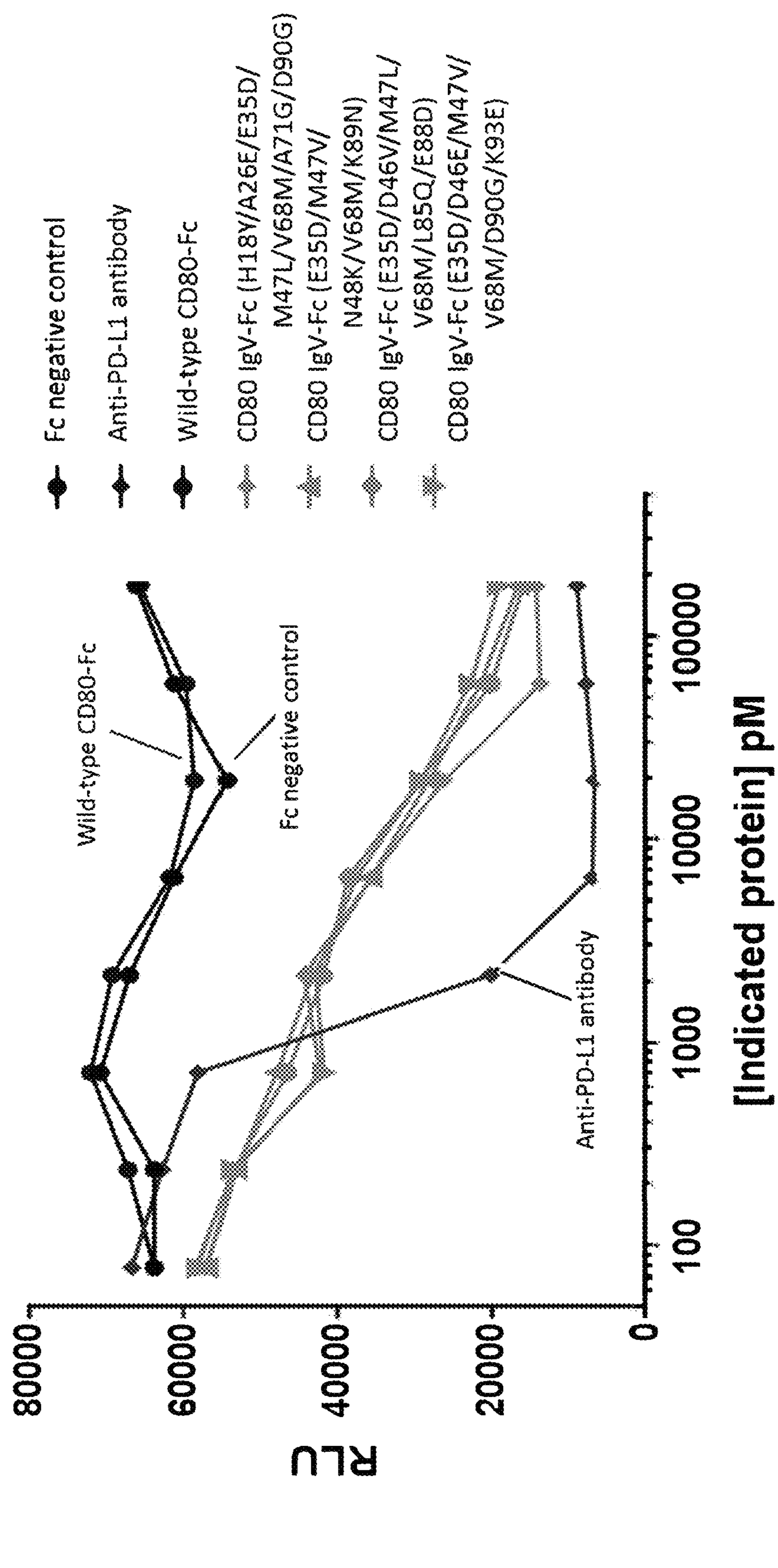
FIG. 20 depicts CD80 IgV-Fc variant antagonism of PD-L1-mediated SHP-2 recruitment to PD-1 using an enzyme complementation assay.

As shown in FIG. 20, the exemplary variant CD80 IgV-Fc molecules decreased luciferase activity, consistent with an observation that the variant CD80 IgV-Fc molecules exhibited potent activity to antagonize PD-L1 mediated PD-1 SHP2 recruitment. Potent antagonist activity also was observed by the anti-PD-L1 positive control, but the wild-type CD80 IgV-Fc molecule did not exhibit PD-1/PD-L1 antagonist activity as evidenced by no decrease in luciferase signal detected in the presence of a wild-type CD80 IgV-Fc molecule.

Example 21

CD80 Variant Antagonism of of B7/CTLA-4 Binding

Figure 21:
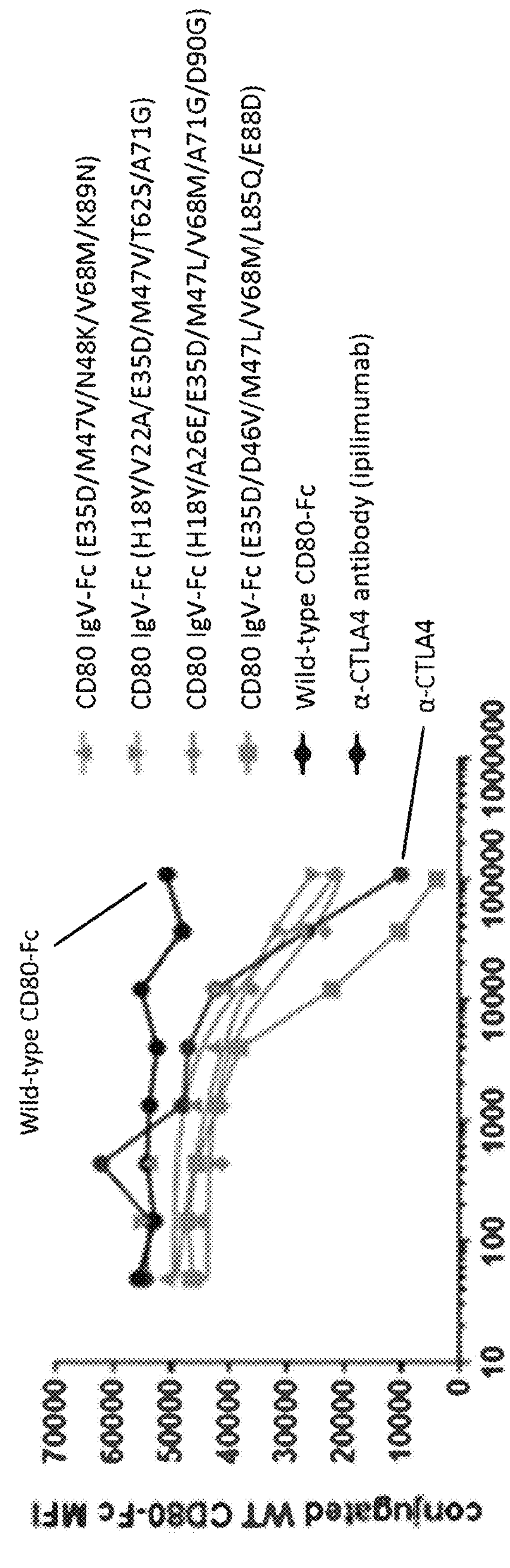
FIG. 21 depicts CD80 IgV-Fc variant antagonism of CD80/CTLA-4 binding.

To assess the ability of CD80 vIgD-Fc to antagonize the interaction of CTLA-4 and B7 binding, CHO cells, stably expressing surface human CTLA-4 were plated with a titration of E35D/M47V/N48K/V68M/K89N (SEQ ID NO: 2250), H18Y/V22A/E35D/M47V/T62S/A71G (SEQ ID NO: 2275), H18Y/A26E/E35D/M47L/V68M/A71G/D90G (SEQ ID NO: 2276) E35D/D46V/M47L/V68M/L85Q/E88D (SEQ ID NO: 2280), or wild-type CD80 vIgD-Fc, or an anti-CTLA-4 antibody (ipilimumab) as a positive control. After washing, cells were incubated with 25 nM fluorochrome-conjugated wild-type CD80-Fc. Bound fluorescent competitor protein was detected and measured by flow cytometry. As shown in FIG. 21, all CD80 vIgD-Fc variants, but not wild-type CD80-Fc, antagonized the binding of CD80 to CTLA-4.

The present invention is not intended to be limited in scope to the particular disclosed embodiments, which are provided, for example, to illustrate various aspects of the invention. Various modifications to the compositions and methods described will become apparent from the description and teachings herein. Such variations may be practiced without departing from the true scope and spirit of the disclosure and are intended to fall within the scope of the present disclosure.

SEQUENCE LISTING (3040 sequences)

SEQ ID NO: 1 - protein, 288 aa, Homo sapiens
  MISC_FEATURE: CD80(B7-1)
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 2 - protein, 208 aa, Homo sapiens [sequence omitted]

SEQ ID NO: 3 - protein, 208 aa, Artificial Sequence
  CD80 v122 ECD
VIHVTKEVKEVATLSCGHNVSVEELAQTRIYWQKEKKMVLTMMSGDMNIWPEYKNRTIFDITNNLSIVIPALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 4 - protein, 208 aa, Artificial Sequence
  CD80 v123 ECD
VIHVTKEVKEVATLSCGHNVSVEELAQTRFYWQKEKKMVLTMMSGDMNIWPEYKNRTIFDITNNLSIVIPALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 5 - protein, 208 aa, Artificial Sequence
  CD80 v124 ECD
VIHVTKEVKEVATLSCGHNVSVEELAHTRIYWQKEKKMVLSMMSGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 6 - protein, 208 aa, Artificial Sequence
  CD80 v125 ECD
VIHVTKEVKEVATLSCGHNVSVEELAQTRTYWQKEKKMVLTMMSGDMNIWPEYKNRTIFDITNNLSIVIRALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 7 - protein, 208 aa, Artificial Sequence
  CD80 v126 ECD
VIHVTKEVKEVARLSRGHNVSVEELAQTRIYWQKEKKMVLTMMSGDMNIWPEYKNRTIFDITNNLSIVIQDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 8 - protein, 208 aa, Artificial Sequence
  CD80 v127 ECD
VIHVTKEVKEVATLSCGHNVSVEELAQTRIYWQKEKKMVLTMMSGDMNIWPEYKNRIIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 9 - protein, 208 aa, Artificial Sequence
  CD80 v128 ECD
VIHVTKEVKEVATLSCGHNVSVEELAQTRIYWQKEKKMVLTMISGDMNIWPEYKNRTIFDITNNLSIVILALRPSDEGTYERVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 10 - protein, 208 aa, Artificial Sequence
  CD80 v130 ECD
VIHVTKEVKEVATLSCGHNVSLEELAQTRIYWQKEKKVVLTMMSGDTNIWPEYKNRTIFDITNNLSIVILDLRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 11 - protein, 208 aa, Artificial Sequence
  CD80 v131 ECD
VIHVTKEVKEVATLSCGHNVSVEELAQTRVYWQKEKKMVLTMMSGDMNIWPEYKNRIIFDITNNLSIVIPDLRPSDEGTYECVVLKYEKDTFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 12 - protein, 208 aa, Artificial Sequence
  CD80 v132 ECD
VIHVTKEVKEVATLSCGHNVSIEELAQTRIYWQKEKKMVLTMMSGDMNIWPEYKNRTIFDITNNLSIVIMDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 13 - protein, 208 aa, Artificial Sequence
  CD80 v133 ECD
VIHVTKEVKEVATLSCGHNVSVEELAQTRIYWQKEKKMVLTMMSGDMNIWPEYKDRTIFDITNNLSIVIPALRPSDGGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 14 - protein, 208 aa, Artificial Sequence
  CD80 v134 ECD
VIHVTKEVKEVATLSCGHNVSVEELAQTRIYWQKEKKMVLTMMSGDMNIWPEYKNRAIFDITNNLSIVTLALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 15 - protein, 208 aa, Artificial Sequence
  CD80 v135 ECD
VIHVTKEVKEVATLSCGHNVSVEELAQTRIYWQKEKKMVLTMMSGDMNIWPEYKDRTIFDITNNLSIVILALRPSDEGTYECVVLMYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 16 - protein, 208 aa, Artificial Sequence
  CD80 v136 ECD
VIHVTKEVKEVATLSCGHNVSVEELAQTRIYWQKEKKMVLTMMSGDMNIWPEYKNRTIFDITNNLSIVILAPRPSDEGIYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 17 - protein, 208 aa, Artificial Sequence
  CD80 v137 ECD
VIHVTKEVKEVATLSCGHNVSVEELAQTRIYWQKEKKMVLTMMSGDMNIWPEYKNRTIFDITNNLSIVIPALRPSDEGTYECVVLKYEKDASKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 18 - protein, 208 aa, Artificial Sequence
  CD80 v138 ECD
VIHVTKEVKEVATLSCGHNVSVEELAQTRIYWQKEKKMVLTMMSGDMNIWPEYKNRTIFDITNNLSIVILALRPSDEGPYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 19 - protein, 208 aa, Artificial Sequence
  CD80 v139 ECD
VIHVTKEVKEVATLSCGHNVSVEELAQTRIYWQKDKKMVLTMMSGDINIWPEYKNRTIFDITNNPSIVILALRPSDEGTYECVVLKYEKNAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 20 - protein, 208 aa, Artificial Sequence
  CD80 v140 ECD
VIHVTKEVKEVATLSCGHNVSVEESAQTRIYWQKDKKMVLTMMSGDINIWPEYKNRTIFDITNNLSIVILALRPSDEGTYECVVLKYEKNAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 21 - protein, 208 aa, Artificial Sequence
  CD80 v141 ECD
VIHVTKEVKEVATLSCGHNVSVEELAQTRIYWQKEKKMVLTMMPGDMNIWPEYKNRTIFDITNNLSTVILALRSSDEGTYGCVVLKYEKDAFKRDHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 22 - protein, 208 aa, Artificial Sequence
  CD80 v142 ECD
VIHVTKEVKEVATLSCGHNVSVEELAQTRIYWQKEKKMVLTMMSGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 23 - protein, 208 aa, Artificial Sequence
  CD80 v143 ECD
VIHVTKEVKEVAALSCGHNVSVEELAQTRIYWQKEKKMVLTMMSGDMNIWPEYKNRTIFDNTNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 24 - protein, 208 aa, Artificial Sequence
  CD80 v144 ECD
VIHVTKEVKEVATLSCGHNVSVEELAQTRIYWQKEKKMVLTMMSGDMNIWPEYKNRTIFDITNNLSIVILALRPSDEGTYKCVVLKYEKDSFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 25 - protein, 208 aa, Artificial Sequence
  CD80 v145 ECD
VIHVTKEVKEVVTLSCGHNVSVEELAQTRIYWQKEKKMVLTMMSGDVNIWPEYKNRTIFDITNNLSIVIMALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 26 - protein, 208 aa, Artificial Sequence
  CD80 v146 ECD
VIHVTKEVKEVATLSCGHNVSVEELAQTRIYWQEEKKMVLAMMSGDMNIWPEYKNRTIFDITNNLSIVILAVRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 27 - protein, 208 aa, Artificial Sequence
  CD80 v147 ECD
VIHVTKEVKEVATLSCGHNVSVEELAQTRIYWQKEKKMVLSMMSGDMNIWPEYKNRTIFDITNNLSIVILDLRPSDEGTYECVALKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 28 - protein, 208 aa, Artificial Sequence
  CD80 v148 ECD
VIHVTKEVKEVATLSCGHNVSVEELAQTRIYWQKDKKMVLTMMSGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 29 - protein, 208 aa, Artificial Sequence
  CD80 v149 ECD
VIHVTKEVKEVATLSCGHNVSVEELAQTRIYWQKDKKMVLTMMSGDINIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 30 - protein, 208 aa, Artificial Sequence
  CD80 v150 ECD
VIHVTKEVKEVATLSCGHNVSVEELAQTRIYWQKERKMVLTMMSGDMNIWPEYKNRTIFDITNNLSIVILALRPSDEATYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 31 - protein, 208 aa, Artificial Sequence
  CD80 v151 ECD
VIHVTKEVKEVATLSCGHNVSVEELAQTRIYWEKEKKMVLAMMSGDMNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 32 - protein, 208 aa, Artificial Sequence
  CD80 v152 ECD
VIHVTKEVKEVATLSCGHNVSVEELAQTRIYWQKEKKMVLTMMSGDVHIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 33 - protein, 208 aa, Artificial Sequence
  CD80 v153 ECD
VIHVTKEVKEVATLSCGHNVSVEELAQTRIYWQKEKKMVLTMMSGDLNIWPEYKNRTIFDITNNLSIAILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 34 - protein, 208 aa, Artificial Sequence
  CD80 v154 ECD
VIHVTKEVKEVATLSCGHNVSVEELAQTRIYWQKEKKMVLTMMPGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 35 - protein, 208 aa, Artificial Sequence
  CD80 v155 ECD
VIHVTKEVKEVATLSCGHNVSVEELAHTRIYWQKEKKMVLTMISGDMNIWPEYKNRTIFDITNNLSIVILDLSPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 36 - protein, 208 aa, Artificial Sequence
  CD80 v156 ECD
  VARIANT (24)..(24): X is unknown
VIHVTKEVKEVATLSCGHNVSVEXLAQTRIYWRKEKKMVLTMMSGDMNIWPEYNNRIIFDITNNLSVVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 37 - protein, 208 aa, Artificial Sequence
  CD80 v157 ECD
VIHVTKEVKEVATLSCGHNVSVEELAQTRIYWQKDKKMVLTMMSGDMNIWPEYKNRIIFDITNNLSIVIQDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 38 - protein, 208 aa, Artificial Sequence
  CD80 v158 ECD
VIHVTKEVKEVATLSCGHNVSVEELAQTRIYWQKEKKMVLTMMSGDINIWPEYKNRTIFDITNNLSIVILALRPSDEGTYECVVLKYDKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 39 - protein, 208 aa, Artificial Sequence
  CD80 v159 ECD
VIHVTKEVKEVATLSCGHNVSVEELAQTRIYWQKEKKMVLTIMSGDMNIWPEYKNRTIFDVTNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 40 - protein, 208 aa, Artificial Sequence
  CD80 v160 ECD
VIHVTKEVKEVATLSCGHNVSVEELAQTRIYWQKEKKMVLTMMSGDMNIWAEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 41 - protein, 208 aa, Artificial Sequence
  CD80 v161 ECD
VIHVTKEVKEVATLSCGYNVSVEELAQTRIYWQKEKKMVLTMMSGDINIWPEYKNRIIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 42 - protein, 208 aa, Artificial Sequence
  CD80 v162 ECD
VIHVTKEVKEVATLSCGHNISVEELAQTRIYWQKEKKMVLTMMSGDVNIWPEYKNRIIFDITNNLSIVILALRPSDEGTYECVILKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 43 - protein, 208 aa, Artificial Sequence
  CD80 v163 ECD
VIHVTKEVKEVATLSCGHNISVEELAQTRIYWQKEKKMVLTMMSGDVNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 44 - protein, 208 aa, Artificial Sequence
  CD80 v164 ECD
VIHVTKEVKEVATLSCGHNVSVEELAQTRIYWQKEKKMVLTMMSGDMNIWPEYKNRTIFDITNNLSIVILDVRPSDEGTYECVVLKYEKDAFKRKHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 45 - protein, 208 aa, Artificial Sequence
  CD80 v165 ECD
VIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 46 - protein, 208 aa, Artificial Sequence; identical to SEQ ID NO: 28
  CD80 v166 ECD

SEQ ID NO: 47 - protein, 208 aa, Artificial Sequence
  CD80 v167 ECD
VIHVTKEVKEVATLSCGHNVSVEELAQTRIYWQKDKKMVLTMMSGDMNIWPEYKNRTIFDITNNLSLVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 48 - protein, 208 aa, Artificial Sequence
  CD80 v168 ECD
VIHVTKEVKEVATLSCGHNVSVEELAHTRIYWQKGKKMVLTMMSGDMNIWPEYKNRTIFDITNNLSIVILDPRPSDEGIYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 49 - protein, 208 aa, Artificial Sequence
  CD80 v169 ECD
VIHVTKEVKEVARLSCGHNVSVEELAQTRIYWQKEKKMVLTVMSGDINIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 50 - protein, 208 aa, Artificial Sequence
  CD80 v170 ECD
VIHVTKEVKEVATLSCGHNVSVEELAQTRIYWQKDKKMVLTMMSGDMNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 51 - protein, 208 aa, Artificial Sequence
  CD80 v171 ECD
VIHVTKEVKEVATLSCGHNVSVEELAQTRIYWQKDKKMVLTMMSGDINIWPEYKNRTIFDITNNLSIVIMALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 52 - protein, 208 aa, Artificial Sequence
  CD80 v172 ECD
VIHVTKEVKEVATLSCGHNVSVEELAQTRIYWQKDKKMVLTMMSGDMNIWPEYKNRTIFDITNNLSIVILDVRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 53 - protein, 208 aa, Artificial Sequence
  CD80 v173 ECD
VIHVTKEVKEVATLSCGHNVSVEELAQTRIYWQKDKKMVLTMLSGDMNIWPEYKNRTIFDITNNLSIVIMALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 54 - protein, 208 aa, Artificial Sequence
  CD80 v174 ECD
VIHVTKEVKEVATLSCGHNVSVEELPQTRIYWQKDKKMVLTMISGDMNIWPEYKNRTIFDITNNLSIVILALRPSDEGTYECVVQKYDKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 55 - protein, 208 aa, Artificial Sequence
  CD80 v175 ECD
VIHVTKEVKEVATLSCGHNVSVEELAQTRIYWQKDKKMVLTMMSGVMNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 56 - protein, 208 aa, Artificial Sequence
  CD80 v176 ECD
VIHVTKEVKEVATLSCGHNVSVEELALTRIYWQKDKKMVLTMMSGDINIWPEYKNRIIFDITNNLSIVIQALRPSDEGTYECVVLKYDKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 57 - protein, 208 aa, Artificial Sequence
  CD80 v177 ECD
VIHVTKEVKEVATLSCGHNVSVEELAQTRIYWQKEKKMVLTMMSGDVNIWPEYKNRTIFDITNNLSIVFLDLRPSDEGTYECIVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 58 - protein, 208 aa, Artificial Sequence
  CD80 v178 ECD
VIHVTKEVKEVATLSCGHNVSVEELAQTRIYWQKDKKMVLTMMSGDMNIWPEYKNRAIFDITNNLSIVILDLRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 59 - protein, 208 aa, Artificial Sequence
  CD80 v179 ECD
VIHVTKEVKEVATLSCGYNVSVEELTQTRIYWQKDKKMVLTMMSGDMNIWPEYKNRTIFDITNNLSIVILDLRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 60 - protein, 208 aa, Artificial Sequence
  CD80 v180 ECD
VIHVTKEVKEVATLSCGHNVSVEELAQTRIYWQKDKKMVLTMMSGDLNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 61 - protein, 208 aa, Artificial Sequence
  CD80 v181 ECD
VIHVTKEVKEVATLSCGHNVSVDELAQTRIYWQKEKKMVLTVISGDMNIWPEYKNRTVFDITNNLSIVIRALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 62 - protein, 208 aa, Artificial Sequence
  CD80 v182 ECD
VIHVTKEVKEVATLSCGHNVSVEELAQTRIYWQKEKKMVLTMMSGDMNIWPEYKNRTIFDITNNLSIMIMDLRPSDEGTYECVVLKYEKDAFKRKHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 63 - protein, 208 aa, Artificial Sequence
  CD80 v183 ECD
VIHVTKEVKEVATLSCGHNVSVEELAQTRIYWQKEKKMVLTMMSGDMNIWPEYKIRIIFDITNNLSIVFLALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 64 - protein, 208 aa, Artificial Sequence
  CD80 v184 ECD
VIHVTKEVKEVATLSCGHNVSVEELAQTRIYWQKDKKMVLTMISGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 65 - protein, 208 aa, Artificial Sequence
  CD80 v185 ECD
VIHVTKEVKEVATLSCGHNVSVEELAQTRIYWQKEKKMVLSMMSGDMNIWPEYKNRIIFDITNNLSIVIRALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 66 - protein, 208 aa, Artificial Sequence
  CD80 v186 ECD
VIHVTKEVKEVATLSCGYNVSVEELAQTRIYWQKEKKMVLTMMSGDMNIWPEYKNRTIFDITNNLSIVILDPRPSDEGTYECVVLKYVKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 67 - protein, 208 aa, Artificial Sequence
  CD80 v187 ECD
VIHVTKEVKEVATLSCGHNISVEELAQTRIYWQKEKKMVLTMMSGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 68 - protein, 208 aa, Artificial Sequence
  CD80 v188 ECD
VIHVTKEVKEVATLSCGHNVSVGELSQTRIYWQKDKKMVLTMMSGDMNIWPEYKNRTIFDINNNLSIVILDVRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 69 - protein, 208 aa, Artificial Sequence
  CD80 v189 ECD
VIHVTKEVKEVTTLSCGHNVSVEDLAQTRIYWQKDKKMVLTMMSGVMNIWPEYKNRTIFDVTNNLSIVILAPRPSDEGTYECVVLKYEKDAFKRVHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 70 - protein, 208 aa, Artificial Sequence
  CD80 v190 ECD
VIHVTKEVKEVATLSCGHNVSLEELAQTRIYWQKDKKMVLTMLSGDMNIWPEYKNRTIFDITNNLSIVILGLRPSHEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 71 - protein, 208 aa, Artificial Sequence
  CD80 v191 ECD
VIHVTKEVKEVATLSCGHNVSVEELAQTRIYWQKGKKMVLTMMSGDMNIWPEYENRTIFDITNNLSIVILDPRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 72 - protein, 208 aa, Artificial Sequence
  CD80 v192 ECD
VIHVTKEVKEVATLSCGHNVSVEELAQTRIYWQKEKKMVLTMMSGDMNIWPEYKNRTIFDITNNLSIVIQDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 73 - protein, 208 aa, Artificial Sequence
  CD80 v193 ECD
VIHVTKEVKEVATLSCGHNVSVEELEQTRIYWQKDKKMVLTMMSGDLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 74 - protein, 208 aa, Artificial Sequence
  CD80 v194 ECD
VIHVTKEVKEVATLSCGHNVSVEELAQTRIYWQKEKKMVLTMMSGEMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 75 - protein, 208 aa, Artificial Sequence
  CD80 v195 ECD
VIHVTKEVKEVATLSCGHNVSVEELAQTRIHWQKDKKMVLSMMSGDMNIWPEYKNRTIFDITNNLSILILALRPSDEGTYECVVLKYEKDAFRWEHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 76 - protein, 101 aa, Artificial Sequence
  CD80 WT IgV
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVT

SEQ ID NO: 77 - protein, 101 aa, Artificial Sequence
  CD80 v122 IgV
VIHVTKEVKEVATLSCGHNVSVEELAQTRIYWQKEKKMVLTMMSGDMNIWPEYKNRTIFDITNNLSIVIPALRPSDEGTYECVVLKYEKDAFKREHLAEVT

SEQ ID NO: 78 - protein, 101 aa, Artificial Sequence
  CD80 v123 IgV
VIHVTKEVKEVATLSCGHNVSVEELAQTRFYWQKEKKMVLTMMSGDMNIWPEYKNRTIFDITNNLSIVIPALRPSDEGTYECVVLKYEKDAFKREHLAEVT

SEQ ID NO: 79 - protein, 101 aa, Artificial Sequence
  CD80 v124 IgV
VIHVTKEVKEVATLSCGHNVSVEELAHTRIYWQKEKKMVLSMMSGDMNIWPEYKNRTIFDITNNLSIVILDLRPSDEGTYECVVLKYEKDAFKREHLAEVT

SEQ ID NO: 80 - protein, 101 aa, Artificial Sequence
  CD80 v125 IgV
VIHVTKEVKEVATLSCGHNVSVEELAQTRTYWQKEKKMVLTMMSGDMNIWPEYKNRTIFDITNNLSIVIRALRPSDEGTYECVVLKYEKDAFKREHLAEVT

SEQ ID NO: 81 - protein, 101 aa, Artificial Sequence
  CD80 v126 IgV
VIHVTKEVKEVARLSRGHNVSVEELAQTRIYWQKEKKMVLTMMSGDMNIWPEYKNRTIFDITNNLSIVIQDLRPSDEGTYECVVLKYEKDAFKREHLAEVT

SEQ ID NO: 82 - protein, 101 aa, Artificial Sequence
  CD80 v127 IgV
VIHVTKEVKEVATLSCGHNVSVEELAQTRIYWQKEKKMVLTMMSGDMNIWPEYKNRIIFDITNNLSIVILALRPSDEGTYECVVLKYEKDAFKREHLAEVT

SEQ ID NO: 83 - protein, 101 aa, Artificial Sequence
  CD80 v128 IgV
VIHVTKEVKEVATLSCGHNVSVEELAQTRIYWQKEKKMVLTMISGDMNIWPEYKNRTIFDITNNLSIVILALRPSDEGTYERVVLKYEKDAFKREHLAEVT

SEQ ID NO: 84 - protein, 101 aa, Artificial Sequence
  CD80 v130 IgV
VIHVTKEVKEVATLSCGHNVSLEELAQTRIYWQKEKKVVLTMMSGDTNIWPEYKNRTIFDITNNLSIVILDLRPSDEGTYECVVMKYEKDAFKREHLAEVT

SEQ ID NO: 85 - protein, 101 aa, Artificial Sequence
  CD80 v131 IgV
VIHVTKEVKEVATLSCGHNVSVEELAQTRVYWQKEKKMVLTMMSGDMNIWPEYKNRIIFDITNNLSIVIPDLRPSDEGTYECVVLKYEKDTFKREHLAEVT

SEQ ID NO: 86 - protein, 101 aa, Artificial Sequence
  CD80 v132 IgV
VIHVTKEVKEVATLSCGHNVSIEELAQTRIYWQKEKKMVLTMMSGDMNIWPEYKNRTIFDITNNLSIVIMDLRPSDEGTYECVVLKYEKDAFKREHLAEVT

SEQ ID NO: 87 - protein, 101 aa, Artificial Sequence
  CD80 v133 IgV
VIHVTKEVKEVATLSCGHNVSVEELAQTRIYWQKEKKMVLTMMSGDMNIWPEYKDRTIFDITNNLSIVIPALRPSDGGTYECVVLKYEKDAFKREHLAEVT

SEQ ID NO: 88 - protein, 101 aa, Artificial Sequence
  CD80 v134 IgV
VIHVTKEVKEVATLSCGHNVSVEELAQTRIYWQKEKKMVLTMMSGDMNIWPEYKNRAIFDITNNLSIVTLALRPSDEGTYECVVLKYEKDAFKREHLAEVT

SEQ ID NO: 89 - protein, 101 aa, Artificial Sequence
  CD80 v135 IgV
VIHVTKEVKEVATLSCGHNVSVEELAQTRIYWQKEKKMVLTMMSGDMNIWPEYKDRTIFDITNNLSIVILALRPSDEGTYECVVLMYEKDAFKREHLAEVT

SEQ ID NO: 90 - protein, 101 aa, Artificial Sequence
  CD80 v136 IgV
VIHVTKEVKEVATLSCGHNVSVEELAQTRIYWQKEKKMVLTMMSGDMNIWPEYKNRTIFDITNNLSIVILAPRPSDEGIYECVVLKYEKDAFKREHLAEVT

SEQ ID NO: 91 - protein, 101 aa, Artificial Sequence
  CD80 v137 IgV
VIHVTKEVKEVATLSCGHNVSVEELAQTRIYWQKEKKMVLTMMSGDMNIWPEYKNRTIFDITNNLSIVIPALRPSDEGTYECVVLKYEKDASKREHLAEVT

SEQ ID NO: 92 - protein, 101 aa, Artificial Sequence
  CD80 v138 IgV
VIHVTKEVKEVATLSCGHNVSVEELAQTRIYWQKEKKMVLTMMSGDMNIWPEYKNRTIFDITNNLSIVILALRPSDEGPYECVVLKYEKDAFKREHLAEVT

SEQ ID NO: 93 - protein, 101 aa, Artificial Sequence
  CD80 v139 IgV
VIHVTKEVKEVATLSCGHNVSVEELAQTRIYWQKDKKMVLTMMSGDINIWPEYKNRTIFDITNNPSIVILALRPSDEGTYECVVLKYEKNAFKREHLAEVT

SEQ ID NO: 94 - protein, 101 aa, Artificial Sequence
  CD80 v140 IgV
VIHVTKEVKEVATLSCGHNVSVEESAQTRIYWQKDKKMVLTMMSGDINIWPEYKNRTIFDITNNLSIVILALRPSDEGTYECVVLKYEKNAFKREHLAEVT

SEQ ID NO: 95 - protein, 101 aa, Artificial Sequence
  CD80 v141 IgV
VIHVTKEVKEVATLSCGHNVSVEELAQTRIYWQKEKKMVLTMMPGDMNIWPEYKNRTIFDITNNLSTVILALRSSDEGTYGCVVLKYEKDAFKRDHLAEVT

SEQ ID NO: 96 - protein, 101 aa, Artificial Sequence
  CD80 v142 IgV
VIHVTKEVKEVATLSCGHNVSVEELAQTRIYWQKEKKMVLTMMSGDMNIWPEYKNRTIFDITNNLSIVILDLRPSDEGTYECVVLKYEKDAFKREHLAEVT

SEQ ID NO: 97 - protein, 101 aa, Artificial Sequence
  CD80 v143 IgV
VIHVTKEVKEVAALSCGHNVSVEELAQTRIYWQKEKKMVLTMMSGDMNIWPEYKNRTIFDNTNNLSIVILDLRPSDEGTYECVVLKYEKDAFKREHLAEVT

SEQ ID NO: 98 - protein, 101 aa, Artificial Sequence
  CD80 v144 IgV
VIHVTKEVKEVATLSCGHNVSVEELAQTRIYWQKEKKMVLTMMSGDMNIWPEYKNRTIFDITNNLSIVILALRPSDEGTYKCVVLKYEKDSFKREHLAEVT

SEQ ID NO: 99 - protein, 101 aa, Artificial Sequence
  CD80 v145 IgV
VIHVTKEVKEVVTLSCGHNVSVEELAQTRIYWQKEKKMVLTMMSGDVNIWPEYKNRTIFDITNNLSIVIMALRPSDEGTYECVVLKYEKDAFKREHLAEVT

SEQ ID NO: 100 - protein, 101 aa, Artificial Sequence
  CD80 v146 IgV
VIHVTKEVKEVATLSCGHNVSVEELAQTRIYWQEEKKMVLAMMSGDMNIWPEYKNRTIFDITNNLSIVILAVRPSDEGTYECVVLKYEKDAFKREHLAEVT

SEQ ID NO: 101 - protein, 101 aa, Artificial Sequence
  CD80 v147 IgV
VIHVTKEVKEVATLSCGHNVSVEELAQTRIYWQKEKKMVLSMMSGDMNIWPEYKNRTIFDITNNLSIVILDLRPSDEGTYECVALKYEKDAFKREHLAEVT

SEQ ID NO: 102 - protein, 101 aa, Artificial Sequence
  CD80 v148 IgV
VIHVTKEVKEVATLSCGHNVSVEELAQTRIYWQKDKKMVLTMMSGDMNIWPEYKNRTIFDITNNLSIVILDLRPSDEGTYECVVLKYEKDAFKREHLAEVT

SEQ ID NO: 103 - protein, 101 aa, Artificial Sequence
  CD80 v149 IgV
VIHVTKEVKEVATLSCGHNVSVEELAQTRIYWQKDKKMVLTMMSGDINIWPEYKNRTIFDITNNLSIVILALRPSDEGTYECVVLKYEKDAFKREHLAEVT

SEQ ID NO: 104 - protein, 101 aa, Artificial Sequence
  CD80 v150 IgV
VIHVTKEVKEVATLSCGHNVSVEELAQTRIYWQKERKMVLTMMSGDMNIWPEYKNRTIFDITNNLSIVILALRPSDEATYECVVLKYEKDAFKREHLAEVT

SEQ ID NO: 105 - protein, 101 aa, Artificial Sequence
  CD80 v151 IgV
VIHVTKEVKEVATLSCGHNVSVEELAQTRIYWEKEKKMVLAMMSGDMNIWPEYKNRTIFDITNNLSIVILALRPSDEGTYECVVLKYEKDAFKREHLAEVT

SEQ ID NO: 106 - protein, 101 aa, Artificial Sequence
  CD80 v152 IgV
VIHVTKEVKEVATLSCGHNVSVEELAQTRIYWQKEKKMVLTMMSGDVHIWPEYKNRTIFDITNNLSIVILALRPSDEGTYECVVLKYEKDAFKREHLAEVT

SEQ ID NO: 107 - protein, 101 aa, Artificial Sequence
  CD80 v153 IgV
VIHVTKEVKEVATLSCGHNVSVEELAQTRIYWQKEKKMVLTMMSGDLNIWPEYKNRTIFDITNNLSIAILALRPSDEGTYECVVLKYEKDAFKREHLAEVT

SEQ ID NO: 108 - protein, 101 aa, Artificial Sequence
  CD80 v154 IgV
VIHVTKEVKEVATLSCGHNVSVEELAQTRIYWQKEKKMVLTMMPGDMNIWPEYKNRTIFDITNNLSIVILDLRPSDEGTYECVVLKYEKDAFKREHLAEVT

SEQ ID NO: 109 - protein, 101 aa, Artificial Sequence
  CD80 v155 IgV
VIHVTKEVKEVATLSCGHNVSVEELAHTRIYWQKEKKMVLTMISGDMNIWPEYKNRTIFDITNNLSIVILDLSPSDEGTYECVVLKYEKDAFKREHLAEVT

SEQ ID NO: 110 - protein, 101 aa, Artificial Sequence
  CD80 v156 IgV
  VARIANT (24)..(24): X is unknown
VIHVTKEVKEVATLSCGHNVSVEXLAQTRIYWRKEKKMVLTMMSGDMNIWPEYNNRIIFDITNNLSVVILDLRPSDEGTYECVVLKYEKDAFKREHLAEVT

SEQ ID NO: 111 - protein, 101 aa, Artificial Sequence
  CD80 v157 IgV
VIHVTKEVKEVATLSCGHNVSVEELAQTRIYWQKDKKMVLTMMSGDMNIWPEYKNRIIFDITNNLSIVIQDLRPSDEGTYECVVLKYEKDAFKREHLAEVT

SEQ ID NO: 112 - protein, 101 aa, Artificial Sequence
  CD80 v158 IgV
VIHVTKEVKEVATLSCGHNVSVEELAQTRIYWQKEKKMVLTMMSGDINIWPEYKNRTIFDITNNLSIVILALRPSDEGTYECVVLKYDKDAFKREHLAEVT

SEQ ID NO: 113 - protein, 101 aa, Artificial Sequence
  CD80 v159 IgV
VIHVTKEVKEVATLSCGHNVSVEELAQTRIYWQKEKKMVLTIMSGDMNIWPEYKNRTIFDVTNNLSIVILDLRPSDEGTYECVVLKYEKDAFKREHLAEVT

SEQ ID NO: 114 - protein, 101 aa, Artificial Sequence
  CD80 v160 IgV
VIHVTKEVKEVATLSCGHNVSVEELAQTRIYWQKEKKMVLTMMSGDMNIWAEYKNRTIFDITNNLSIVILDLRPSDEGTYECVVLKYEKDAFKREHLAEVT

SEQ ID NO: 115 - protein, 101 aa, Artificial Sequence
  CD80 v161 IgV
VIHVTKEVKEVATLSCGYNVSVEELAQTRIYWQKEKKMVLTMMSGDINIWPEYKNRIIFDITNNLSIVILGLRPSDEGTYECVVLKYEKDAFKREHLAEVT

SEQ ID NO: 116 - protein, 101 aa, Artificial Sequence
  CD80 v162 IgV
VIHVTKEVKEVATLSCGHNISVEELAQTRIYWQKEKKMVLTMMSGDVNIWPEYKNRIIFDITNNLSIVILALRPSDEGTYECVILKYEKDAFKREHLAEVT

SEQ ID NO: 117 - protein, 101 aa, Artificial Sequence
  CD80 v163 IgV
VIHVTKEVKEVATLSCGHNISVEELAQTRIYWQKEKKMVLTMMSGDVNIWPEYKNRTIFDITNNLSIVILDLRPSDEGTYECVVLKYEKDAFKREHLAEVT

SEQ ID NO: 118 - protein, 101 aa, Artificial Sequence
  CD80 v164 IgV
VIHVTKEVKEVATLSCGHNVSVEELAQTRIYWQKEKKMVLTMMSGDMNIWPEYKNRTIFDITNNLSIVILDVRPSDEGTYECVVLKYEKDAFKRKHLAEVT

SEQ ID NO: 119 - protein, 101 aa, Artificial Sequence
  CD80 v165 IgV
VIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEVT

SEQ ID NO: 120 - protein, 101 aa, Artificial Sequence; identical to SEQ ID NO: 102
  CD80 v166 IgV

SEQ ID NO: 121 - protein, 101 aa, Artificial Sequence
  CD80 v167 IgV
VIHVTKEVKEVATLSCGHNVSVEELAQTRIYWQKDKKMVLTMMSGDMNIWPEYKNRTIFDITNNLSLVILDLRPSDEGTYECVVLKYEKDAFKREHLAEVT

SEQ ID NO: 122 - protein, 101 aa, Artificial Sequence
  CD80 v168 IgV
VIHVTKEVKEVATLSCGHNVSVEELAHTRIYWQKGKKMVLTMMSGDMNIWPEYKNRTIFDITNNLSIVILDPRPSDEGIYECVVLKYEKDAFKREHLAEVT

SEQ ID NO: 123 - protein, 101 aa, Artificial Sequence
  CD80 v169 IgV
VIHVTKEVKEVARLSCGHNVSVEELAQTRIYWQKEKKMVLTVMSGDINIWPEYKNRTIFDITNNLSIVILDLRPSDEGTYECVVLKYEKDAFKREHLAEVT

SEQ ID NO: 124 - protein, 101 aa, Artificial Sequence
  CD80 v170 IgV
VIHVTKEVKEVATLSCGHNVSVEELAQTRIYWQKDKKMVLTMMSGDMNIWPEYKNRTIFDITNNLSIVILALRPSDEGTYECVVLKYEKDAFKREHLAEVT

SEQ ID NO: 125 - protein, 101 aa, Artificial Sequence
  CD80 v171 IgV
VIHVTKEVKEVATLSCGHNVSVEELAQTRIYWQKDKKMVLTMMSGDINIWPEYKNRTIFDITNNLSIVIMALRPSDEGTYECVVLKYEKDAFKREHLAEVT

SEQ ID NO: 126 - protein, 101 aa, Artificial Sequence
  CD80 v172 IgV
VIHVTKEVKEVATLSCGHNVSVEELAQTRIYWQKDKKMVLTMMSGDMNIWPEYKNRTIFDITNNLSIVILDVRPSDEGTYECVVLKYEKDAFKREHLAEVT

SEQ ID NO: 127 - protein, 101 aa, Artificial Sequence
  CD80 v173 IgV
VIHVTKEVKEVATLSCGHNVSVEELAQTRIYWQKDKKMVLTMLSGDMNIWPEYKNRTIFDITNNLSIVIMALRPSDEGTYECVVLKYEKDAFKREHLAEVT

SEQ ID NO: 128 - protein, 101 aa, Artificial Sequence
  CD80 v174 IgV
VIHVTKEVKEVATLSCGHNVSVEELPQTRIYWQKDKKMVLTMISGDMNIWPEYKNRTIFDITNNLSIVILALRPSDEGTYECVVQKYDKDAFKREHLAEVT

SEQ ID NO: 129 - protein, 101 aa, Artificial Sequence
  CD80 v175 IgV
VIHVTKEVKEVATLSCGHNVSVEELAQTRIYWQKDKKMVLTMMSGVMNIWPEYKNRTIFDITNNLSIVILALRPSDEGTYECVVQKYEKDAFKREHLAEVT

SEQ ID NO: 130 - protein, 101 aa, Artificial Sequence
  CD80 v176 IgV
VIHVTKEVKEVATLSCGHNVSVEELALTRIYWQKDKKMVLTMMSGDINIWPEYKNRIIFDITNNLSIVIQALRPSDEGTYECVVLKYDKDAFKREHLAEVT

SEQ ID NO: 131 - protein, 101 aa, Artificial Sequence
  CD80 v177 IgV
VIHVTKEVKEVATLSCGHNVSVEELAQTRIYWQKEKKMVLTMMSGDVNIWPEYKNRTIFDITNNLSIVFLDLRPSDEGTYECIVLKYEKDAFKREHLAEVT

SEQ ID NO: 132 - protein, 101 aa, Artificial Sequence
  CD80 v178 IgV
VIHVTKEVKEVATLSCGHNVSVEELAQTRIYWQKDKKMVLTMMSGDMNIWPEYKNRAIFDITNNLSIVILDLRPSDEGTYECVVQKYEKDAFKREHLAEVT

SEQ ID NO: 133 - protein, 101 aa, Artificial Sequence
  CD80 v179 IgV
VIHVTKEVKEVATLSCGYNVSVEELTQTRIYWQKDKKMVLTMMSGDMNIWPEYKNRTIFDITNNLSIVILDLRPSDEGTYECVVQKYEKDAFKREHLAEVT

SEQ ID NO: 134 - protein, 101 aa, Artificial Sequence
  CD80 v180 IgV
VIHVTKEVKEVATLSCGHNVSVEELAQTRIYWQKDKKMVLTMMSGDLNIWPEYKNRTIFDITNNLSIVILALRPSDEGTYECVVLKYEKDAFKREHLAEVT

SEQ ID NO: 135 - protein, 101 aa, Artificial Sequence
  CD80 v181 IgV
VIHVTKEVKEVATLSCGHNVSVDELAQTRIYWQKEKKMVLTVISGDMNIWPEYKNRTVFDITNNLSIVIRALRPSDEGTYECVVLKYEKDAFKREHLAEVT

SEQ ID NO: 136 - protein, 101 aa, Artificial Sequence
  CD80 v182 IgV
VIHVTKEVKEVATLSCGHNVSVEELAQTRIYWQKEKKMVLTMMSGDMNIWPEYKNRTIFDITNNLSIMIMDLRPSDEGTYECVVLKYEKDAFKRKHLAEVT

SEQ ID NO: 137 - protein, 101 aa, Artificial Sequence
  CD80 v183 IgV
VIHVTKEVKEVATLSCGHNVSVEELAQTRIYWQKEKKMVLTMMSGDMNIWPEYKIRIIFDITNNLSIVFLALRPSDEGTYECVVLKYEKDAFKREHLAEVT

SEQ ID NO: 138 - protein, 101 aa, Artificial Sequence
  CD80 v184 IgV
VIHVTKEVKEVATLSCGHNVSVEELAQTRIYWQKDKKMVLTMISGDMNIWPEYKNRTIFDITNNLSIVILDLRPSDEGTYECVVLKYEKDAFKREHLAEVT

SEQ ID NO: 139 - protein, 101 aa, Artificial Sequence
  CD80 v185 IgV
VIHVTKEVKEVATLSCGHNVSVEELAQTRIYWQKEKKMVLSMMSGDMNIWPEYKNRIIFDITNNLSIVIRALRPSDEGTYECVVLKYEKDAFKREHLAEVT

SEQ ID NO: 140 - protein, 101 aa, Artificial Sequence
  CD80 v186 IgV
VIHVTKEVKEVATLSCGYNVSVEELAQTRIYWQKEKKMVLTMMSGDMNIWPEYKNRTIFDITNNLSIVILDPRPSDEGTYECVVLKYVKDAFKREHLAEVT

SEQ ID NO: 141 - protein, 101 aa, Artificial Sequence
  CD80 v187 IgV
VIHVTKEVKEVATLSCGHNISVEELAQTRIYWQKEKKMVLTMMSGDMNIWPEYKNRTIFDITNNLSIVILDLRPSDEGTYECVVLKYEKDAFKREHLAEVT

SEQ ID NO: 142 - protein, 101 aa, Artificial Sequence
  CD80 v188 IgV
VIHVTKEVKEVATLSCGHNVSVGELSQTRIYWQKDKKMVLTMMSGDMNIWPEYKNRTIFDINNNLSIVILDVRPSDEGTYECVVMKYEKDAFKREHLAEVT

SEQ ID NO: 143 - protein, 101 aa, Artificial Sequence
  CD80 v189 IgV
VIHVTKEVKEVTTLSCGHNVSVEDLAQTRIYWQKDKKMVLTMMSGVMNIWPEYKNRTIFDVTNNLSIVILAPRPSDEGTYECVVLKYEKDAFKRVHLAEVT

SEQ ID NO: 144 - protein, 101 aa, Artificial Sequence
  CD80 v190 IgV
VIHVTKEVKEVATLSCGHNVSLEELAQTRIYWQKDKKMVLTMLSGDMNIWPEYKNRTIFDITNNLSIVILGLRPSHEGTYECVVLKYEKDAFKREHLAEVT

SEQ ID NO: 145 - protein, 101 aa, Artificial Sequence
  CD80 v191 IgV
VIHVTKEVKEVATLSCGHNVSVEELAQTRIYWQKGKKMVLTMMSGDMNIWPEYENRTIFDITNNLSIVILDPRPSDEGTYECVVLKYEKDAFKREHLAEVT

SEQ ID NO: 146 - protein, 101 aa, Artificial Sequence
  CD80 v192 IgV
VIHVTKEVKEVATLSCGHNVSVEELAQTRIYWQKEKKMVLTMMSGDMNIWPEYKNRTIFDITNNLSIVIQDLRPSDEGTYECVVLKYEKDAFKREHLAEVT

SEQ ID NO: 147 - protein, 101 aa, Artificial Sequence
  CD80 v193 IgV
VIHVTKEVKEVATLSCGHNVSVEELEQTRIYWQKDKKMVLTMMSGDLNIWPEYKNRTIFDITNNLSIVILALRPSDEGTYECVVQKYEKDAFKREHLAEVT

SEQ ID NO: 148 - protein, 101 aa, Artificial Sequence
  CD80 v194 IgV
VIHVTKEVKEVATLSCGHNVSVEELAQTRIYWQKEKKMVLTMMSGEMNIWPEYKNRTIFDITNNLSIVILDLRPSDEGTYECVVLKYEKDAFKREHLAEVT

SEQ ID NO: 149 - protein, 101 aa, Artificial Sequence
  CD80 v195 IgV
VIHVTKEVKEVATLSCGHNVSVEELAQTRIHWQKDKKMVLSMMSGDMNIWPEYKNRTIFDITNNLSILILALRPSDEGTYECVVLKYEKDAFRWEHLAEVT

SEQ ID NO: 150 - protein, 107 aa, Artificial Sequence
  CD80 WT IgV
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKAD

SEQ ID NO: 151 - protein, 107 aa, Artificial Sequence
  CD80 v122 IgV
VIHVTKEVKEVATLSCGHNVSVEELAQTRIYWQKEKKMVLTMMSGDMNIWPEYKNRTIFDITNNLSIVIPALRPSDEGTYECVVLKYEKDAFKREHLAEVTLSVKAD

SEQ ID NO: 152 - protein, 107 aa, Artificial Sequence
  CD80 v123 IgV
VIHVTKEVKEVATLSCGHNVSVEELAQTRFYWQKEKKMVLTMMSGDMNIWPEYKNRTIFDITNNLSIVIPALRPSDEGTYECVVLKYEKDAFKREHLAEVTLSVKAD

SEQ ID NO: 153 - protein, 107 aa, Artificial Sequence
  CD80 v124 IgV
VIHVTKEVKEVATLSCGHNVSVEELAHTRIYWQKEKKMVLSMMSGDMNIWPEYKNRTIFDITNNLSIVILDLRPSDEGTYECVVLKYEKDAFKREHLAEVTLSVKAD

SEQ ID NO: 154 - protein, 107 aa, Artificial Sequence
  CD80 v125 IgV
VIHVTKEVKEVATLSCGHNVSVEELAQTRTYWQKEKKMVLTMMSGDMNIWPEYKNRTIFDITNNLSIVIRALRPSDEGTYECVVLKYEKDAFKREHLAEVTLSVKAD

SEQ ID NO: 155 - protein, 107 aa, Artificial Sequence
  CD80 v126 IgV
VIHVTKEVKEVARLSRGHNVSVEELAQTRIYWQKEKKMVLTMMSGDMNIWPEYKNRTIFDITNNLSIVIQDLRPSDEGTYECVVLKYEKDAFKREHLAEVTLSVKAD

SEQ ID NO: 156 - protein, 107 aa, Artificial Sequence
  CD80 v127 IgV
VIHVTKEVKEVATLSCGHNVSVEELAQTRIYWQKEKKMVLTMMSGDMNIWPEYKNRIIFDITNNLSIVILALRPSDEGTYECVVLKYEKDAFKREHLAEVTLSVKAD

SEQ ID NO: 157 - protein, 107 aa, Artificial Sequence
  CD80 v128 IgV
VIHVTKEVKEVATLSCGHNVSVEELAQTRIYWQKEKKMVLTMISGDMNIWPEYKNRTIFDITNNLSIVILALRPSDEGTYERVVLKYEKDAFKREHLAEVTLSVKAD

SEQ ID NO: 158 - protein, 107 aa, Artificial Sequence
  CD80 v130 IgV
VIHVTKEVKEVATLSCGHNVSLEELAQTRIYWQKEKKVVLTMMSGDTNIWPEYKNRTIFDITNNLSIVILDLRPSDEGTYECVVMKYEKDAFKREHLAEVTLSVKAD

SEQ ID NO: 159 - protein, 107 aa, Artificial Sequence
  CD80 v131 IgV
VIHVTKEVKEVATLSCGHNVSVEELAQTRVYWQKEKKMVLTMMSGDMNIWPEYKNRIIFDITNNLSIVIPDLRPSDEGTYECVVLKYEKDTFKREHLAEVTLSVKAD

SEQ ID NO: 160 - protein, 107 aa, Artificial Sequence
  CD80 v132 IgV
VIHVTKEVKEVATLSCGHNVSIEELAQTRIYWQKEKKMVLTMMSGDMNIWPEYKNRTIFDITNNLSIVIMDLRPSDEGTYECVVLKYEKDAFKREHLAEVTLSVKAD

SEQ ID NO: 161 - protein, 107 aa, Artificial Sequence
  CD80 v133 IgV
VIHVTKEVKEVATLSCGHNVSVEELAQTRIYWQKEKKMVLTMMSGDMNIWPEYKDRTIFDITNNLSIVIPALRPSDGGTYECVVLKYEKDAFKREHLAEVTLSVKAD

SEQ ID NO: 162 - protein, 107 aa, Artificial Sequence
  CD80 v134 IgV
VIHVTKEVKEVATLSCGHNVSVEELAQTRIYWQKEKKMVLTMMSGDMNIWPEYKNRAIFDITNNLSIVTLALRPSDEGTYECVVLKYEKDAFKREHLAEVTLSVKAD

SEQ ID NO: 163 - protein, 107 aa, Artificial Sequence
  CD80 v135 IgV
VIHVTKEVKEVATLSCGHNVSVEELAQTRIYWQKEKKMVLTMMSGDMNIWPEYKDRTIFDITNNLSIVILALRPSDEGTYECVVLMYEKDAFKREHLAEVTLSVKAD

SEQ ID NO: 164 - protein, 107 aa, Artificial Sequence
  CD80 v136 IgV
VIHVTKEVKEVATLSCGHNVSVEELAQTRIYWQKEKKMVLTMMSGDMNIWPEYKNRTIFDITNNLSIVILAPRPSDEGIYECVVLKYEKDAFKREHLAEVTLSVKAD

SEQ ID NO: 165 - protein, 107 aa, Artificial Sequence
  CD80 v137 IgV
VIHVTKEVKEVATLSCGHNVSVEELAQTRIYWQKEKKMVLTMMSGDMNIWPEYKNRTIFDITNNLSIVIPALRPSDEGTYECVVLKYEKDASKREHLAEVTLSVKAD

SEQ ID NO: 166 - protein, 107 aa, Artificial Sequence
  CD80 v138 IgV
VIHVTKEVKEVATLSCGHNVSVEELAQTRIYWQKEKKMVLTMMSGDMNIWPEYKNRTIFDITNNLSIVILALRPSDEGPYECVVLKYEKDAFKREHLAEVTLSVKAD

SEQ ID NO: 167 - protein, 107 aa, Artificial Sequence
  CD80 v139 IgV
VIHVTKEVKEVATLSCGHNVSVEELAQTRIYWQKDKKMVLTMMSGDINIWPEYKNRTIFDITNNPSIVILALRPSDEGTYECVVLKYEKNAFKREHLAEVTLSVKAD

SEQ ID NO: 168 - protein, 107 aa, Artificial Sequence
  CD80 v140 IgV
VIHVTKEVKEVATLSCGHNVSVEESAQTRIYWQKDKKMVLTMMSGDINIWPEYKNRTIFDITNNLSIVILALRPSDEGTYECVVLKYEKNAFKREHLAEVTLSVKAD

SEQ ID NO: 169 - protein, 107 aa, Artificial Sequence
  CD80 v141 IgV
VIHVTKEVKEVATLSCGHNVSVEELAQTRIYWQKEKKMVLTMMPGDMNIWPEYKNRTIFDITNNLSTVILALRSSDEGTYGCVVLKYEKDAFKRDHLAEVTLSVKAD

SEQ ID NO: 170 - protein, 107 aa, Artificial Sequence
  CD80 v142 IgV
VIHVTKEVKEVATLSCGHNVSVEELAQTRIYWQKEKKMVLTMMSGDMNIWPEYKNRTIFDITNNLSIVILDLRPSDEGTYECVVLKYEKDAFKREHLAEVTLSVKAD

SEQ ID NO: 171 - protein, 107 aa, Artificial Sequence
  CD80 v143 IgV
VIHVTKEVKEVAALSCGHNVSVEELAQTRIYWQKEKKMVLTMMSGDMNIWPEYKNRTIFDNTNNLSIVILDLRPSDEGTYECVVLKYEKDAFKREHLAEVTLSVKAD

SEQ ID NO: 172 - protein, 107 aa, Artificial Sequence
  CD80 v144 IgV
VIHVTKEVKEVATLSCGHNVSVEELAQTRIYWQKEKKMVLTMMSGDMNIWPEYKNRTIFDITNNLSIVILALRPSDEGTYKCVVLKYEKDSFKREHLAEVTLSVKAD

SEQ ID NO: 173 - protein, 107 aa, Artificial Sequence
  CD80 v145 IgV
VIHVTKEVKEVVTLSCGHNVSVEELAQTRIYWQKEKKMVLTMMSGDVNIWPEYKNRTIFDITNNLSIVIMALRPSDEGTYECVVLKYEKDAFKREHLAEVTLSVKAD

SEQ ID NO: 174 - protein, 107 aa, Artificial Sequence
  CD80 v146 IgV
VIHVTKEVKEVATLSCGHNVSVEELAQTRIYWQEEKKMVLAMMSGDMNIWPEYKNRTIFDITNNLSIVILAVRPSDEGTYECVVLKYEKDAFKREHLAEVTLSVKAD

SEQ ID NO: 175 - protein, 107 aa, Artificial Sequence
  CD80 v147 IgV
VIHVTKEVKEVATLSCGHNVSVEELAQTRIYWQKEKKMVLSMMSGDMNIWPEYKNRTIFDITNNLSIVILDLRPSDEGTYECVALKYEKDAFKREHLAEVTLSVKAD

SEQ ID NO: 176 - protein, 107 aa, Artificial Sequence
  CD80 v148 IgV
VIHVTKEVKEVATLSCGHNVSVEELAQTRIYWQKDKKMVLTMMSGDMNIWPEYKNRTIFDITNNLSIVILDLRPSDEGTYECVVLKYEKDAFKREHLAEVTLSVKAD

SEQ ID NO: 177 - protein, 107 aa, Artificial Sequence
  CD80 v149 IgV
VIHVTKEVKEVATLSCGHNVSVEELAQTRIYWQKDKKMVLTMMSGDINIWPEYKNRTIFDITNNLSIVILALRPSDEGTYECVVLKYEKDAFKREHLAEVTLSVKAD

SEQ ID NO: 178 - protein, 107 aa, Artificial Sequence
  CD80 v150 IgV
VIHVTKEVKEVATLSCGHNVSVEELAQTRIYWQKERKMVLTMMSGDMNIWPEYKNRTIFDITNNLSIVILALRPSDEATYECVVLKYEKDAFKREHLAEVTLSVKAD

SEQ ID NO: 179 - protein, 107 aa, Artificial Sequence
  CD80 v151 IgV
VIHVTKEVKEVATLSCGHNVSVEELAQTRIYWEKEKKMVLAMMSGDMNIWPEYKNRTIFDITNNLSIVILALRPSDEGTYECVVLKYEKDAFKREHLAEVTLSVKAD

SEQ ID NO: 180 - protein, 107 aa, Artificial Sequence
  CD80 v152 IgV
VIHVTKEVKEVATLSCGHNVSVEELAQTRIYWQKEKKMVLTMMSGDVHIWPEYKNRTIFDITNNLSIVILALRPSDEGTYECVVLKYEKDAFKREHLAEVTLSVKAD

SEQ ID NO: 181 - protein, 107 aa, Artificial Sequence
  CD80 v153 IgV
VIHVTKEVKEVATLSCGHNVSVEELAQTRIYWQKEKKMVLTMMSGDLNIWPEYKNRTIFDITNNLSIAILALRPSDEGTYECVVLKYEKDAFKREHLAEVTLSVKAD

SEQ ID NO: 182 - protein, 107 aa, Artificial Sequence
  CD80 v154 IgV
VIHVTKEVKEVATLSCGHNVSVEELAQTRIYWQKEKKMVLTMMPGDMNIWPEYKNRTIFDITNNLSIVILDLRPSDEGTYECVVLKYEKDAFKREHLAEVTLSVKAD

SEQ ID NO: 183 - protein, 107 aa, Artificial Sequence
  CD80 v155 IgV
VIHVTKEVKEVATLSCGHNVSVEELAHTRIYWQKEKKMVLTMISGDMNIWPEYKNRTIFDITNNLSIVILDLSPSDEGTYECVVLKYEKDAFKREHLAEVTLSVKAD

SEQ ID NO: 184 - protein, 107 aa, Artificial Sequence
  CD80 v156 IgV
  VARIANT (24)..(24): X is unknown
VIHVTKEVKEVATLSCGHNVSVEXLAQTRIYWRKEKKMVLTMMSGDMNIWPEYNNRIIFDITNNLSVVILDLRPSDEGTYECVVLKYEKDAFKREHLAEVTLSVKAD

SEQ ID NO: 185 - protein, 107 aa, Artificial Sequence
  CD80 v157 IgV
VIHVTKEVKEVATLSCGHNVSVEELAQTRIYWQKDKKMVLTMMSGDMNIWPEYKNRIIFDITNNLSIVIQDLRPSDEGTYECVVLKYEKDAFKREHLAEVTLSVKAD

SEQ ID NO: 186 - protein, 107 aa, Artificial Sequence
  CD80 v158 IgV
VIHVTKEVKEVATLSCGHNVSVEELAQTRIYWQKEKKMVLTMMSGDINIWPEYKNRTIFDITNNLSIVILALRPSDEGTYECVVLKYDKDAFKREHLAEVTLSVKAD

SEQ ID NO: 187 - protein, 107 aa, Artificial Sequence
  CD80 v159 IgV
VIHVTKEVKEVATLSCGHNVSVEELAQTRIYWQKEKKMVLTIMSGDMNIWPEYKNRTIFDVTNNLSIVILDLRPSDEGTYECVVLKYEKDAFKREHLAEVTLSVKAD

SEQ ID NO: 188 - protein, 107 aa, Artificial Sequence
  CD80 v160 IgV
VIHVTKEVKEVATLSCGHNVSVEELAQTRIYWQKEKKMVLTMMSGDMNIWAEYKNRTIFDITNNLSIVILDLRPSDEGTYECVVLKYEKDAFKREHLAEVTLSVKAD

SEQ ID NO: 189 - protein, 107 aa, Artificial Sequence
  CD80 v161 IgV
VIHVTKEVKEVATLSCGYNVSVEELAQTRIYWQKEKKMVLTMMSGDINIWPEYKNRIIFDITNNLSIVILGLRPSDEGTYECVVLKYEKDAFKREHLAEVTLSVKAD

SEQ ID NO: 190 - protein, 107 aa, Artificial Sequence
  CD80 v162 IgV
VIHVTKEVKEVATLSCGHNISVEELAQTRIYWQKEKKMVLTMMSGDVNIWPEYKNRIIFDITNNLSIVILALRPSDEGTYECVILKYEKDAFKREHLAEVTLSVKAD

SEQ ID NO: 191 - protein, 107 aa, Artificial Sequence
  CD80 v163 IgV
VIHVTKEVKEVATLSCGHNISVEELAQTRIYWQKEKKMVLTMMSGDVNIWPEYKNRTIFDITNNLSIVILDLRPSDEGTYECVVLKYEKDAFKREHLAEVTLSVKAD

SEQ ID NO: 192 - protein, 107 aa, Artificial Sequence
  CD80 v164 IgV
VIHVTKEVKEVATLSCGHNVSVEELAQTRIYWQKEKKMVLTMMSGDMNIWPEYKNRTIFDITNNLSIVILDVRPSDEGTYECVVLKYEKDAFKRKHLAEVTLSVKAD

SEQ ID NO: 193 - protein, 107 aa, Artificial Sequence
  CD80 v165 IgV
VIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEVTLSVKAD

SEQ ID NO: 194 - protein, 107 aa, Artificial Sequence; identical to SEQ ID NO: 176
  CD80 v166 IgV

SEQ ID NO: 195 - protein, 107 aa, Artificial Sequence
  CD80 v167 IgV
VIHVTKEVKEVATLSCGHNVSVEELAQTRIYWQKDKKMVLTMMSGDMNIWPEYKNRTIFDITNNLSLVILDLRPSDEGTYECVVLKYEKDAFKREHLAEVTLSVKAD

SEQ ID NO: 196 - protein, 107 aa, Artificial Sequence
  CD80 v168 IgV
VIHVTKEVKEVATLSCGHNVSVEELAHTRIYWQKGKKMVLTMMSGDMNIWPEYKNRTIFDITNNLSIVILDPRPSDEGIYECVVLKYEKDAFKREHLAEVTLSVKAD

SEQ ID NO: 197 - protein, 107 aa, Artificial Sequence
  CD80 v169 IgV
VIHVTKEVKEVARLSCGHNVSVEELAQTRIYWQKEKKMVLTVMSGDINIWPEYKNRTIFDITNNLSIVILDLRPSDEGTYECVVLKYEKDAFKREHLAEVTLSVKAD

SEQ ID NO: 198 - protein, 107 aa, Artificial Sequence
  CD80 v170 IgV
VIHVTKEVKEVATLSCGHNVSVEELAQTRIYWQKDKKMVLTMMSGDMNIWPEYKNRTIFDITNNLSIVILALRPSDEGTYECVVLKYEKDAFKREHLAEVTLSVKAD

SEQ ID NO: 199 - protein, 107 aa, Artificial Sequence
  CD80 v171 IgV
VIHVTKEVKEVATLSCGHNVSVEELAQTRIYWQKDKKMVLTMMSGDINIWPEYKNRTIFDITNNLSIVIMALRPSDEGTYECVVLKYEKDAFKREHLAEVTLSVKAD

SEQ ID NO: 200 - protein, 107 aa, Artificial Sequence
  CD80 v172 IgV
VIHVTKEVKEVATLSCGHNVSVEELAQTRIYWQKDKKMVLTMMSGDMNIWPEYKNRTIFDITNNLSIVILDVRPSDEGTYECVVLKYEKDAFKREHLAEVTLSVKAD

SEQ ID NO: 201 - protein, 107 aa, Artificial Sequence
  CD80 v173 IgV
VIHVTKEVKEVATLSCGHNVSVEELAQTRIYWQKDKKMVLTMLSGDMNIWPEYKNRTIFDITNNLSIVIMALRPSDEGTYECVVLKYEKDAFKREHLAEVTLSVKAD

SEQ ID NO: 202 - protein, 107 aa, Artificial Sequence
  CD80 v174 IgV
VIHVTKEVKEVATLSCGHNVSVEELPQTRIYWQKDKKMVLTMISGDMNIWPEYKNRTIFDITNNLSIVILALRPSDEGTYECVVQKYDKDAFKREHLAEVTLSVKAD

SEQ ID NO: 203 - protein, 107 aa, Artificial Sequence
  CD80 v175 IgV
VIHVTKEVKEVATLSCGHNVSVEELAQTRIYWQKDKKMVLTMMSGVMNIWPEYKNRTIFDITNNLSIVILALRPSDEGTYECVVQKYEKDAFKREHLAEVTLSVKAD

SEQ ID NO: 204 - protein, 107 aa, Artificial Sequence
  CD80 v176 IgV
VIHVTKEVKEVATLSCGHNVSVEELALTRIYWQKDKKMVLTMMSGDINIWPEYKNRIIFDITNNLSIVIQALRPSDEGTYECVVLKYDKDAFKREHLAEVTLSVKAD

SEQ ID NO: 205 - protein, 107 aa, Artificial Sequence
  CD80 v177 IgV
VIHVTKEVKEVATLSCGHNVSVEELAQTRIYWQKEKKMVLTMMSGDVNIWPEYKNRTIFDITNNLSIVFLDLRPSDEGTYECIVLKYEKDAFKREHLAEVTLSVKAD

SEQ ID NO: 206 - protein, 107 aa, Artificial Sequence
  CD80 v178 IgV
VIHVTKEVKEVATLSCGHNVSVEELAQTRIYWQKDKKMVLTMMSGDMNIWPEYKNRAIFDITNNLSIVILDLRPSDEGTYECVVQKYEKDAFKREHLAEVTLSVKAD

SEQ ID NO: 207 - protein, 107 aa, Artificial Sequence
  CD80 v179 IgV
VIHVTKEVKEVATLSCGYNVSVEELTQTRIYWQKDKKMVLTMMSGDMNIWPEYKNRTIFDITNNLSIVILDLRPSDEGTYECVVQKYEKDAFKREHLAEVTLSVKAD

SEQ ID NO: 208 - protein, 107 aa, Artificial Sequence
  CD80 v180 IgV
VIHVTKEVKEVATLSCGHNVSVEELAQTRIYWQKDKKMVLTMMSGDLNIWPEYKNRTIFDITNNLSIVILALRPSDEGTYECVVLKYEKDAFKREHLAEVTLSVKAD

SEQ ID NO: 209 - protein, 107 aa, Artificial Sequence
  CD80 v181 IgV
VIHVTKEVKEVATLSCGHNVSVDELAQTRIYWQKEKKMVLTVISGDMNIWPEYKNRTVFDITNNLSIVIRALRPSDEGTYECVVLKYEKDAFKREHLAEVTLSVKAD

SEQ ID NO: 210 - protein, 107 aa, Artificial Sequence
  CD80 v182 IgV
VIHVTKEVKEVATLSCGHNVSVEELAQTRIYWQKEKKMVLTMMSGDMNIWPEYKNRTIFDITNNLSIMIMDLRPSDEGTYECVVLKYEKDAFKRKHLAEVTLSVKAD

SEQ ID NO: 211 - protein, 107 aa, Artificial Sequence
  CD80 v183 IgV
VIHVTKEVKEVATLSCGHNVSVEELAQTRIYWQKEKKMVLTMMSGDMNIWPEYKIRIIFDITNNLSIVFLALRPSDEGTYECVVLKYEKDAFKREHLAEVTLSVKAD

SEQ ID NO: 212 - protein, 107 aa, Artificial Sequence
  CD80 v184 IgV
VIHVTKEVKEVATLSCGHNVSVEELAQTRIYWQKDKKMVLTMISGDMNIWPEYKNRTIFDITNNLSIVILDLRPSDEGTYECVVLKYEKDAFKREHLAEVTLSVKAD

SEQ ID NO: 213 - protein, 107 aa, Artificial Sequence
  CD80 v185 IgV
VIHVTKEVKEVATLSCGHNVSVEELAQTRIYWQKEKKMVLSMMSGDMNIWPEYKNRIIFDITNNLSIVIRALRPSDEGTYECVVLKYEKDAFKREHLAEVTLSVKAD

SEQ ID NO: 214 - protein, 107 aa, Artificial Sequence
  CD80 v186 IgV
VIHVTKEVKEVATLSCGYNVSVEELAQTRIYWQKEKKMVLTMMSGDMNIWPEYKNRTIFDITNNLSIVILDPRPSDEGTYECVVLKYVKDAFKREHLAEVTLSVKAD

SEQ ID NO: 215 - protein, 107 aa, Artificial Sequence
  CD80 v187 IgV
VIHVTKEVKEVATLSCGHNISVEELAQTRIYWQKEKKMVLTMMSGDMNIWPEYKNRTIFDITNNLSIVILDLRPSDEGTYECVVLKYEKDAFKREHLAEVTLSVKAD

SEQ ID NO: 216 - protein, 107 aa, Artificial Sequence
  CD80 v188 IgV
VIHVTKEVKEVATLSCGHNVSVGELSQTRIYWQKDKKMVLTMMSGDMNIWPEYKNRTIFDINNNLSIVILDVRPSDEGTYECVVMKYEKDAFKREHLAEVTLSVKAD

SEQ ID NO: 217 - protein, 107 aa, Artificial Sequence
  CD80 v189 IgV
VIHVTKEVKEVTTLSCGHNVSVEDLAQTRIYWQKDKKMVLTMMSGVMNIWPEYKNRTIFDVTNNLSIVILAPRPSDEGTYECVVLKYEKDAFKRVHLAEVTLSVKAD

SEQ ID NO: 218 - protein, 107 aa, Artificial Sequence
  CD80 v190 IgV
VIHVTKEVKEVATLSCGHNVSLEELAQTRIYWQKDKKMVLTMLSGDMNIWPEYKNRTIFDITNNLSIVILGLRPSHEGTYECVVLKYEKDAFKREHLAEVTLSVKAD

SEQ ID NO: 219 - protein, 107 aa, Artificial Sequence
  CD80 v191 IgV
VIHVTKEVKEVATLSCGHNVSVEELAQTRIYWQKGKKMVLTMMSGDMNIWPEYENRTIFDITNNLSIVILDPRPSDEGTYECVVLKYEKDAFKREHLAEVTLSVKAD

SEQ ID NO: 220 - protein, 107 aa, Artificial Sequence
  CD80 v192 IgV
VIHVTKEVKEVATLSCGHNVSVEELAQTRIYWQKEKKMVLTMMSGDMNIWPEYKNRTIFDITNNLSIVIQDLRPSDEGTYECVVLKYEKDAFKREHLAEVTLSVKAD

SEQ ID NO: 221 - protein, 107 aa, Artificial Sequence
  CD80 v193 IgV
VIHVTKEVKEVATLSCGHNVSVEELEQTRIYWQKDKKMVLTMMSGDLNIWPEYKNRTIFDITNNLSIVILALRPSDEGTYECVVQKYEKDAFKREHLAEVTLSVKAD

SEQ ID NO: 222 - protein, 107 aa, Artificial Sequence
  CD80 v194 IgV
VIHVTKEVKEVATLSCGHNVSVEELAQTRIYWQKEKKMVLTMMSGEMNIWPEYKNRTIFDITNNLSIVILDLRPSDEGTYECVVLKYEKDAFKREHLAEVTLSVKAD

SEQ ID NO: 223 - protein, 107 aa, Artificial Sequence
  CD80 v195 IgV
VIHVTKEVKEVATLSCGHNVSVEELAQTRIHWQKDKKMVLSMMSGDMNIWPEYKNRTIFDITNNLSILILALRPSDEGTYECVVLKYEKDAFRWEHLAEVTLSVKAD

SEQ ID NO: 224 - protein, 329 aa, Homo sapiens
  MISC_FEATURE: CD86(B7-2)
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 225 - protein, 290 aa, Homo sapiens
  MISC_FEATURE: CD274 (PD-L1, B7-H1)
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 226 - protein, 273 aa, Homo sapiens
  MISC_FEATURE: PDCD1LG2(PD-L2, CD273)
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 227 - protein, 302 aa, Homo sapiens
  MISC_FEATURE: ICOSLG(B7RP1, CD275, ICOSL, B7-H2)
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 228 - protein, 534 aa, Homo sapiens
  MISC_FEATURE: CD276(B7-H3)
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 229 - protein, 282 aa, Homo sapiens
  MISC_FEATURE: VTCN1(B7-H4)
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 230 - protein, 220 aa, Homo sapiens
  MISC_FEATURE: CD28
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 231 - protein, 223 aa, Homo sapiens
  MISC_FEATURE: CTLA4
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 232 - protein, 288 aa, Homo sapiens
  MISC_FEATURE: PDCD1(PD-1)
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 233 - protein, 199 aa, Homo sapiens
  MISC_FEATURE: ICOS
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 234 - protein, 289 aa, Homo sapiens
  MISC_FEATURE: BTLA(CD272)
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 235 - protein, 458 aa, Homo sapiens
  MISC_FEATURE: CD4
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 236 - protein, 235 aa, Homo sapiens
  MISC_FEATURE: CD8A(CD8-alpha)
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 237 - protein, 210 aa, Homo sapiens
  MISC_FEATURE: CD8B(CD8-beta)
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 238 - protein, 525 aa, Homo sapiens
  MISC_FEATURE: LAG3
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 239 - protein, 301 aa, Homo sapiens
  MISC_FEATURE: HAVCR2(TIM-3)
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 240 - protein, 526 aa, Homo sapiens
  MISC_FEATURE: CEACAM1
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 241 - protein, 244 aa, Homo sapiens
  MISC_FEATURE: TIGIT
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 242 - protein, 417 aa, Homo sapiens
  MISC_FEATURE: PVR(CD155)
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 243 - protein, 538 aa, Homo sapiens
  MISC_FEATURE: PVRL2(CD112)
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 244 - protein, 336 aa, Homo sapiens
  MISC_FEATURE: CD226
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 245 - protein, 351 aa, Homo sapiens
  MISC_FEATURE: CD2
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 246 - protein, 180 aa, Homo sapiens
  MISC_FEATURE: CD160
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQA

SEQ ID NO: 247 - protein, 278 aa, Homo sapiens
  MISC_FEATURE: CD200
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 248 - protein, 325 aa, Homo sapiens [sequence omitted]

SEQ ID NO: 249 - protein, 201 aa, Homo sapiens
  MISC_FEATURE: NC R3 (NKp30)
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 250 - protein, 224 aa, Homo sapiens
  MISC_FEATURE: CD86(B7-2) ECD
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 251 - protein, 220 aa, Homo sapiens
  MISC_FEATURE: CD274 (PD-L1, B7-H1) ECD
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 252 - protein, 201 aa, Homo sapiens
  MISC_FEATURE: PDCD1LG2(PD-L2, CD273) ECD
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 253 - protein, 238 aa, Homo sapiens [sequence omitted]

SEQ ID NO: 254 - protein, 438 aa, Homo sapiens
  MISC_FEATURE: CD276(B7-H3) ECD
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEA

SEQ ID NO: 255 - protein, 235 aa, Homo sapiens
  MISC_FEATURE: VTCN1(B7-H4) ECD
LIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKAS

SEQ ID NO: 256 - protein, 134 aa, Homo sapiens
  MISC_FEATURE: CD28 ECD
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKP

SEQ ID NO: 257 - protein, 126 aa, Homo sapiens [sequence omitted]

SEQ ID NO: 258 - protein, 150 aa, Homo sapiens [sequence omitted]

SEQ ID NO: 259 - protein, 120 aa, Homo sapiens
  MISC_FEATURE: ICOS ECD
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLK

SEQ ID NO: 260 - protein, 127 aa, Homo sapiens
  MISC_FEATURE: BTLA(CD272) ECD
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYR

SEQ ID NO: 261 - protein, 371 aa, Homo sapiens
  MISC_FEATURE: CD4 ECD
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 262 - protein, 161 aa, Homo sapiens
  MISC_FEATURE: CD8A(CD8-alpha) ECD
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACD

SEQ ID NO: 263 - protein, 149 aa, Homo sapiens
  MISC_FEATURE: CD8B(CD8-beta) ECD
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSP

SEQ ID NO: 264 - protein, 422 aa, Homo sapiens
  MISC_FEATURE: LAG3 ECD
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHL

SEQ ID NO: 265 - protein, 181 aa, Homo sapiens
  MISC_FEATURE: HAVCR2(TIM-3) ECD
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIG

SEQ ID NO: 266 - protein, 394 aa, Homo sapiens
  MISC_FEATURE: CEACAM1 ECD
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPG

SEQ ID NO: 267 - protein, 120 aa, Homo sapiens
  MISC_FEATURE: TIGIT ECD
MMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIP

SEQ ID NO: 268 - protein, 323 aa, Homo sapiens
  MISC_FEATURE: PVR(CD155) ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 269 - protein, 329 aa, Homo sapiens
  MISC_FEATURE: PVRL2(CD112) ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 270 - protein, 236 aa, Homo sapiens [sequence omitted]

SEQ ID NO: 271 - protein, 185 aa, Homo sapiens
  MISC_FEATURE: CD2 ECD
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLD

SEQ ID NO: 272 - protein, 133 aa, Homo sapiens
  MISC_FEATURE: CD160 ECD
INITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLS

SEQ ID NO: 273 - protein, 202 aa, Homo sapiens
  MISC_FEATURE: CD200 ECD
QVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKG

SEQ ID NO: 274 - protein, 215 aa, Homo sapiens
  MISC_FEATURE: CD200R1(CD200R) ECD
MDEKQITQNYSKVLAEVNTSWPVKMATNAVLCCPPIALRNLIIITWEIILRGQPSCTKAYRKETNETKETNCTDERITWVSRPDQNSDLQIRPVAITHDGYYRCIMVTPDGNFHRGYHLQVLVTPEVTLFQNRNRTAVCKAVAGKPAAQISWIPEGDCATKQEYWSNGTVTVKSTCHWEVHNVSTVTCHVSHLTGNKSLYIELLPVPGAKKSAKL

SEQ ID NO: 275 - protein, 117 aa, Homo sapiens
  MISC_FEATURE: NC R3 (NKp30) ECD
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLG

SEQ ID NO: 276 - protein, 19 aa, Artificial Sequence
  VH signal peptide
MGSTAILALLLAVLQGVSA

SEQ ID NO: 277 - protein, 232 aa, Artificial Sequence
  IgG1 Fc
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 278 - protein, 235 aa, Artificial Sequence
  IgG2 Fc
TKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 279 - protein, 254 aa, Homo sapiens
  MISC_FEATURE: Mature CD80(B7-1)
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 280 - protein, 306 aa, Homo sapiens
  MISC_FEATURE: Mature CD86(B7-2)
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 281 - protein, 272 aa, Homo sapiens
  MISC_FEATURE: Mature CD274 (PD-L1, B7-H1)
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 282 - protein, 254 aa, Homo sapiens
  MISC_FEATURE: Mature PDCD1LG2(PD-L2, CD273)
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 283 - protein, 284 aa, Homo sapiens
  MISC_FEATURE: Mature ICOSLG(B7RP1, CD275, ICOSL, B7-H2)
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 284 - protein, 506 aa, Homo sapiens
  MISC_FEATURE: Mature CD276(B7-H3)
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 285 - protein, 258 aa, Homo sapiens
  MISC_FEATURE: Mature VTCN1(B7-H4)
LIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 286 - protein, 202 aa, Homo sapiens
  MISC_FEATURE: Mature CD28
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 287 - protein, 188 aa, Homo sapiens
  MISC_FEATURE: Mature CTLA4
KAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 288 - protein, 268 aa, Homo sapiens
  MISC_FEATURE: Mature PDCD1(PD-1)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 289 - protein, 179 aa, Homo sapiens
  MISC_FEATURE: Mature ICOS
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 290 - protein, 259 aa, Homo sapiens
  MISC_FEATURE: Mature BTLA(CD272)
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 291 - protein, 433 aa, Homo sapiens
  MISC_FEATURE: Mature CD4
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 292 - protein, 214 aa, Homo sapiens
  MISC_FEATURE: Mature CD8A(CD8-alpha)
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 293 - protein, 189 aa, Homo sapiens
  MISC_FEATURE: Mature CD8B(CD8-beta)
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 294 - protein, 497 aa, Homo sapiens
  MISC_FEATURE: Mature LAG3
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 295 - protein, 280 aa, Homo sapiens
  MISC_FEATURE: Mature HAVCR2(TIM-3)
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 296 - protein, 492 aa, Homo sapiens
  MISC_FEATURE: Mature CEACAM1
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 297 - protein, 222 aa, Homo sapiens
  MISC_FEATURE: Mature TIGIT
MTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 298 - protein, 397 aa, Homo sapiens
  MISC_FEATURE: Mature PVR(CD155)
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 299 - protein, 507 aa, Homo sapiens
  MISC_FEATURE: Mature PVRL2(CD112)
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 300 - protein, 318 aa, Homo sapiens
  MISC_FEATURE: Mature CD226
EEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 301 - protein, 327 aa, Homo sapiens
  MISC_FEATURE: Mature CD2
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 302 - protein, 154 aa, Homo sapiens
  MISC_FEATURE: Mature CD160
INITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQA

SEQ ID NO: 303 - protein, 248 aa, Homo sapiens
  MISC_FEATURE: Mature CD200
QVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 304 - protein, 297 aa, Homo sapiens
  MISC_FEATURE: Mature CD200R1(CD200R)
MDEKQITQNYSKVLAEVNTSWPVKMATNAVLCCPPIALRNLIIITWEIILRGQPSCTKAYRKETNETKETNCTDERITWVSRPDQNSDLQIRPVAITHDGYYRCIMVTPDGNFHRGYHLQVLVTPEVTLFQNRNRTAVCKAVAGKPAAQISWIPEGDCATKQEYWSNGTVTVKSTCHWEVHNVSTVTCHVSHLTGNKSLYIELLPVPGAKKSAKLYIPYIILTIIILTIVGFIWLLKVNGCRKYKLNKTESTPVVEEDEMQPYASYTEKNNPLYDTTNKVKASEALQSEVDTDLHTL

SEQ ID NO: 305 - protein, 183 aa, Homo sapiens
  MISC_FEATURE: Mature NC R3 (NKp30)
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 306 - protein, 414 aa, Homo sapiens
  MISC_FEATURE: VSIG8
MRVGGAFHLLLVCLSPALLSAVRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 307 - protein, 393 aa, Homo sapiens
  MISC_FEATURE: Mature VSIG8
VRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 308 - protein, 242 aa, Homo sapiens
  MISC_FEATURE: VSIG8 ECD
VRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIG

SEQ ID NO: 309 - protein, 16 aa, Artificial Sequence
  CD33 Signal Peptide
MPLLLLLPLLWAGALA

SEQ ID NO: 310 - protein, 22 aa, Artificial Sequence
  IgGkappa light chain
MDMRVLAQLLGLLLLCFPGARC

SEQ ID NO: 311 - protein, 18 aa, Artificial Sequence
  HSA signal peptide
MKWVTFISLLFLFSSAYS

SEQ ID NO: 312 - protein, 22 aa, Artificial Sequence
  Ig kappa light chain
MDMRAPAGIFGFLLVLFPGYRS

SEQ ID NO: 313 - protein, 19 aa, Artificial Sequence
  Human azurocidin preprotein signal sequence
MTRLTVLALLAGLLASSRA

SEQ ID NO: 314 - protein, 19 aa, Artificial Sequence
  IgG heavy chain signal peptide
MELGLSWIFLLAILKGVQC

SEQ ID NO: 315 - protein, 19 aa, Artificial Sequence
  IgG heavy chain signal peptide
MELGLRWVFLVAILEGVQC

SEQ ID NO: 316 - protein, 19 aa, Artificial Sequence
  IgG heavy chain signal peptide
MKHLWFFLLLVAAPRWVLS

SEQ ID NO: 317 - protein, 19 aa, Artificial Sequence
  IgG heavy chain signal peptide
MDWTWRILFLVAAATGAHS

SEQ ID NO: 318 - protein, 19 aa, Artificial Sequence
  IgG heavy chain signal peptide
MDWTWRFLFVVAAATGVQS

SEQ ID NO: 319 - protein, 19 aa, Artificial Sequence
  IgG heavy chain signal peptide
MEFGLSWLFLVAILKGVQC

SEQ ID NO: 320 - protein, 19 aa, Artificial Sequence
  IgG heavy chain signal peptide
MEFGLSWVFLVALFRGVQC

SEQ ID NO: 321 - protein, 26 aa, Artificial Sequence
  IgG heavy chain signal peptide
MDLLHKNMKHLWFFLLLVAAPRWVLS

SEQ ID NO: 322 - protein, 22 aa, Artificial Sequence
  IgG Kappa light chain signal seqeunce
MDMRVPAQLLGLLLLWLSGARC

SEQ ID NO: 323 - protein, 22 aa, Artificial Sequence
  IgG Kappa light chain signal seqeunce
MKYLLPTAAAGLLLLAAQPAMA

SEQ ID NO: 324 - protein, 17 aa, Artificial Sequence
  Gaussia luciferase
MGVKVLFALICIAVAEA

SEQ ID NO: 325 - protein, 18 aa, Artificial Sequence
  Human albumin
MKWVTFISLLFLFSSAYS

SEQ ID NO: 326 - protein, 18 aa, Artificial Sequence
  Human chymotrypsinogen
MAFLWLLSCWALLGTTFG

SEQ ID NO: 327 - protein, 14 aa, Artificial Sequence
  Human interleukin-2
MQLLSCIALILALV

SEQ ID NO: 328 - protein, 15 aa, Artificial Sequence
  Human trysinogen-2
MNLLLILTFVAAAVA

SEQ ID NO: 329 - protein, 15 aa, Artificial Sequence
  IgV-IgV linker
GGGGSGGGGSGGGGS

SEQ ID NO: 330 - protein, 10 aa, Artificial Sequence
  IgV-Fc linker 1
GGGGSGGGGS

SEQ ID NO: 331 - protein, 13 aa, Artificial Sequence
  IgV-Fc linker 2
GGGGSGGGGSAAA

SEQ ID NO: 332 - protein, 71 aa, Artificial Sequence
  CD8-derived hinge and transmembrane domain
KPTTTPAPRPPTPAPTIASQPLSLRPEASRPAAGGAVHTRGLDFASDIYIWAPLAGTCGVLLLSLVITLYC

SEQ ID NO: 333 - protein, 112 aa, Artificial Sequence
  CD3zeta intracellular signaling domain
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 334 - protein, 117 aa, Artificial Sequence
  NKp30 v1 ECD
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLG

SEQ ID NO: 335 - protein, 117 aa, Artificial Sequence
  NKp30 v2 ECD
LWVSQPPEIRTLEGSSAFLPCSFNASQGRVAIGSVTWFRDEVVPGKEVRNGTPEFRGRLAPLASSRFLHDHQAELHIRDVRGHDASIYVCRVEVLGLGVGTGNGTRLVVEKEHPQLG

SEQ ID NO: 336 - protein, 117 aa, Artificial Sequence
  NKp30 v3 ECD
LWVSQPPEIRTLEGSSAFLPCSFNASQGRLAIGSVTWFRDEVVPGKEVRNGTPEFRGRLVPLASSRFLHDHQAELHIRDVRGHDASIYVCRVEVLGLGVGTGNGTRLVVEKEHPQLG

SEQ ID NO: 337 - protein, 117 aa, Artificial Sequence
  NKp30 v4 ECD
LWVSQPPEIRTLEGSSAFLPCSFNASQGRLAIGSVTWFRDEVVPGKEVRNGTPEFRGRLAPLAPSRFLHDHQAELHIRDVRGHDASIYVCRVEVLGLGVGTGNGTRLVVEKEHPQLG

SEQ ID NO: 338 - protein, 117 aa, Artificial Sequence
  NKp30 v5 ECD
LWVSQPPEIRTLEGSSAFLPCSFNASQGRLAIGSVTWFRDEVVPGKEVRNGTPEFRGRLAPLASSRFLHDHQAELHIRDVRGHDAGIYVCRVEVLGLGVGTGNGTRLVVEKEHPQLG

SEQ ID NO: 339 - protein, 224 aa, Artificial Sequence
  CD86 v1 ECD
APLKIQAYFNETADLPCQFANSQNQSLSELVVFWHDQENLVLNEVYLGKEKFDSVHSKYMGRTSFDSDSWTLRLHNLQIKDKGLYQCIILHKKPTGMIRIHHMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 340 - protein, 224 aa, Artificial Sequence
  CD86 v2 ECD
APLKIQAYFNETADLPCQFANSQNQSLSELVVFWHDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 341 - protein, 224 aa, Artificial Sequence
  CD86 v3 ECD
APLKIQAYFNETADLPCQFANSQNQSLSELVVFWQDQENLVLNEVYLGKEKFDSVHSKYMGRTSFDSDSWTLRLHNLQIKDKGLYQCIILHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 342 - protein, 224 aa, Artificial Sequence
  CD86 v4 ECD
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHHMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 343 - protein, 108 aa, Homo sapiens
  MISC_FEATURE: NKp30 WT IgC-like
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLV

SEQ ID NO: 344 - protein, 108 aa, Artificial Sequence
  NKp30 v1 IgC-like
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLV

SEQ ID NO: 345 - protein, 108 aa, Artificial Sequence
  NKp30 v2 IgC-like
LWVSQPPEIRTLEGSSAFLPCSFNASQGRVAIGSVTWFRDEVVPGKEVRNGTPEFRGRLAPLASSRFLHDHQAELHIRDVRGHDASIYVCRVEVLGLGVGTGNGTRLV

SEQ ID NO: 346 - protein, 108 aa, Artificial Sequence
  NKp30 v3 IgC-like
LWVSQPPEIRTLEGSSAFLPCSFNASQGRLAIGSVTWFRDEVVPGKEVRNGTPEFRGRLVPLASSRFLHDHQAELHIRDVRGHDASIYVCRVEVLGLGVGTGNGTRLV

SEQ ID NO: 347 - protein, 108 aa, Artificial Sequence
  NKp30 v4 IgC-like
LWVSQPPEIRTLEGSSAFLPCSFNASQGRLAIGSVTWFRDEVVPGKEVRNGTPEFRGRLAPLAPSRFLHDHQAELHIRDVRGHDASIYVCRVEVLGLGVGTGNGTRLV

SEQ ID NO: 348 - protein, 108 aa, Artificial Sequence
  NKp30 v5 IgC-like
LWVSQPPEIRTLEGSSAFLPCSFNASQGRLAIGSVTWFRDEVVPGKEVRNGTPEFRGRLAPLASSRFLHDHQAELHIRDVRGHDAGIYVCRVEVLGLGVGTGNGTRLV

SEQ ID NO: 349 - protein, 99 aa, Homo sapiens
  MISC_FEATURE: CD86 WT IgV
NETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELS

SEQ ID NO: 350 - protein, 99 aa, Artificial Sequence
  CD86 v1 IgV
NETADLPCQFANSQNQSLSELVVFWHDQENLVLNEVYLGKEKFDSVHSKYMGRTSFDSDSWTLRLHNLQIKDKGLYQCIILHKKPTGMIRIHHMNSELS

SEQ ID NO: 351 - protein, 99 aa, Artificial Sequence
  CD86 v2 IgV
NETADLPCQFANSQNQSLSELVVFWHDQENLVLNEVYLGKEKFDSVHSKYMGRTSFDSDSWTLRLHNLQIKDKGLYQCIIHHKKPTGMIRIHQMNSELS

SEQ ID NO: 352 - protein, 99 aa, Artificial Sequence
  CD86 v3 IgV
NETADLPCQFANSQNQSLSELVVFWQDQENLVLNEVYLGKEKFDSVHSKYMGRTSFDSDSWTLRLHNLQIKDKGLYQCIILHKKPTGMIRIHQMNSELS

SEQ ID NO: 353 - protein, 99 aa, Artificial Sequence
  CD86 v4 IgV
NETADLPCQFANSQNQSLSELVVFWQDQENLVLNEVYLGKEKFDSVHSKYMGRTSFDSDSWTLRLHNLQIKDKGLYQCIIHHKKPTGMIRIHHMNSELS

SEQ ID NO: 354 - protein, 270 aa, Artificial Sequence
  Nkp30 stack
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSVGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGGGGGSGGGGSAAAEPK

SEQ ID NO: 355 - protein, 116 aa, Artificial Sequence
  NKp30 v1 IgC-like (long)
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQL

SEQ ID NO: 356 - protein, 232 aa, Artificial Sequence
  Fc (C5S (C220S), R77C, (R292C),  N82G (N297G), V87C (V302C))
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 357 - protein, 232 aa, Artificial Sequence
  Fc with C220S/L234A/L235E/G237A
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 358 - protein, 231 aa, Artificial Sequence
  Fc with C220S/E233P/L234V/L235A/G236del/S267K
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 359 - protein, 231 aa, Homo sapiens
  MISC_FEATURE: wild-type human IgG1-delK
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 360 - protein, 431 aa, Artificial Sequence
  antiCD19z chimeric antigen receptor
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 361 - protein, 21 aa, Artificial Sequence
  CD8-derived signal sequence
MALPVTALLLPLALLLHAARP

SEQ ID NO: 362 - protein, 23 aa, Artificial Sequence
  CD8-derived signal sequence
MALPVTALLLPLALLLHAARPGS

SEQ ID NO: 363 - protein, 245 aa, Artificial Sequence
  anti-CD19 scFv
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 364 - protein, 69 aa, Artificial Sequence
  CD8-derived hinge and transmembrane domain
AKPTTTPAPRPPTPAPTIASQPLSLRPEACRPAAGGAVHTRGLDFACDIYIWAPLAGTCGVLLLSLVIT

SEQ ID NO: 365 - protein, 42 aa, Artificial Sequence
  4-1BB-derived costimulatory domain
KRGRKKLLYIFKQPFMRPVQTTQEEDGCSCRFPEEEEGGCEL

SEQ ID NO: 366 - protein, 40 aa, Artificial Sequence
  CD28-derived costimulatory domain
SKRSRLLHSDYMNMTPRRPGPTRKHYQPYAPPRDFAAYRS

SEQ ID NO: 367 - protein, 41 aa, Artificial Sequence
  CD28-derived costimulatory domain
RSKRSRLLHSDYMNMTPRRPGPTRKHYQPYAPPRDFAAYRS

SEQ ID NO: 368 - protein, 44 aa, Artificial Sequence
  CD28-derived costimulatory domain
FWVRSKRSRLLHSDYMNMTPRRPGPTRKHYQPYAPPRDFAAYRS

SEQ ID NO: 369 - protein, 20 aa, Artificial Sequence
  T2A protein
SGEGRGSLLTCGDVEENPGP

SEQ ID NO: 370 - protein, 232 aa, Artificial Sequence
  Blue fluorescent protein
SELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 371 - protein, 472 aa, Artificial Sequence
  2nd Gen CAR
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 372 - protein, 497 aa, Artificial Sequence
  2nd Gen CAR
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGRSGEGRGSLLTCGDVEENPGPSR

SEQ ID NO: 373 - protein, 471 aa, Artificial Sequence
  2nd Gen CAR with CD28-derived costimulatory domain
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 374 - protein, 232 aa, Artificial Sequence
  Knob Fc
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 375 - protein, 232 aa, Artificial Sequence
  Hole Fc
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 376 - protein, 232 aa, Artificial Sequence
  Stack Fc (homodimeric)
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 377 - protein, 8 aa, Artificial Sequence
  Stuffer
HMSSVSAQ

SEQ ID NO: 378 - protein, 116 aa, Homo sapiens
  MISC_FEATURE: CD155 IgV
PGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWL

SEQ ID NO: 379 - protein, 323 aa, Artificial Sequence
  CD155 v1 ECD
WPPPGTGDVVVQAPTQVSGFLGDSVTLPCYLQVPNMEVTHVSQLTWARHGESGSMAVFHQTQGSSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 380 - protein, 323 aa, Artificial Sequence
  CD155 v2 ECD
WPPPGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCPFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 381 - protein, 323 aa, Artificial Sequence
  CD155 v3 ECD
WPPPGTGDVVVQAPTQVPGFLGDSVTLPCYLQVPNMEVTHVSQPTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 382 - protein, 323 aa, Artificial Sequence
  CD155 v4 ECD
WPPPGTGDVVVQAPTQVPGFLGDSVTLPCYLQVPNMEVTHVSQLTWARHGESGSMVVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 383 - protein, 323 aa, Artificial Sequence
  CD155 v5 ECD
WPPPGTGDVVVQAPTQVLGFLGDSVTLPCYLQVPNMEVTHVSQLTWARHGESGSMAVFHQTQGPSYSESKRLEFVAARVGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 384 - protein, 323 aa, Artificial Sequence
  CD155 v6 ECD
WPPPGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 385 - protein, 323 aa, Artificial Sequence
  CD155 v7 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 386 - protein, 323 aa, Artificial Sequence
  CD155 v8 ECD
WPPPGTGDVVVQAPTQVTGFLGDSVTLPCYLQVPNMEVTHVPQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 387 - protein, 323 aa, Artificial Sequence
  CD155 v9 ECD
WPPPGTEDVVVQAPTQVTGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 388 - protein, 323 aa, Artificial Sequence
  CD155 v10 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQDSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 389 - protein, 323 aa, Artificial Sequence
  CD155 v11 ECD
WPPPGTGDVVVQAPTQVSGFLGDSVTLPCYLQVPNMEVTHVSQLTWARHGESGSMAVFHQTQGPSYSESKRLEFVAARLGAELRNASLRMPGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 390 - protein, 323 aa, Artificial Sequence
  CD155 v12 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTLPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 391 - protein, 323 aa, Artificial Sequence
  CD155 v14 ECD
WPPPGTGDVVVQAPTQVTGFLGDSVTLPCYLQVPNMEVTHVSQLAWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 392 - protein, 323 aa, Artificial Sequence
  CD155 v15 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLHVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 393 - protein, 323 aa, Artificial Sequence
  CD155 v16 ECD
WPPPGTGDVVVQAPTQVSGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 394 - protein, 323 aa, Artificial Sequence
  CD155 v17 ECD
WPPPGTGDVVVQAPTQVPGFLGDSVTLPCYLQVPNMEVTHVSQLTWARHGESGSMAVFHQTQGPSYSESKRLEFVAARLGVEPRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 395 - protein, 323 aa, Artificial Sequence
  CD155 v18 ECD
WPPPGTGDVVVQAPTQVPGFLGDSVTLPCYLQVPNMEVTHVSQLTWARHGESGSMAVFHQTQGPSYSESKRLEFVAARLGAELRNASPRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 396 - protein, 323 aa, Artificial Sequence
  CD155 v19 ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLHVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 397 - protein, 323 aa, Artificial Sequence
  CD155 v20 ECD
WPPPGTGDVVVQEPTQVSGFLGDSVTLPCYLQVPNMEVTHVSQLTWARHGESGSMVVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 398 - protein, 323 aa, Artificial Sequence
  CD155 v21 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSADIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 399 - protein, 323 aa, Artificial Sequence
  CD155 v22 ECD
WPPPGTGDVVVQAPTQVTGFLGDSVTLPCYLQVPNMEVTHVSQLTWARHGESGSMAVFHKTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 400 - protein, 116 aa, Artificial Sequence
  CD155 v1 IgV
PGTGDVVVQAPTQVSGFLGDSVTLPCYLQVPNMEVTHVSQLTWARHGESGSMAVFHQTQGSSYSESKRLEFVAARLGAELRNASLRMSGLRVEDEGNYTCLFVTFPQGSRSVDIWL

SEQ ID NO: 401 - protein, 116 aa, Artificial Sequence
  CD155 v2 IgV
PGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCPFVTFPQGSRSVDIWL

SEQ ID NO: 402 - protein, 116 aa, Artificial Sequence
  CD155 v3 IgV
PGTGDVVVQAPTQVPGFLGDSVTLPCYLQVPNMEVTHVSQPTWARHGESGSMAVFHQTQGPSYSESKRLEFVAARLGAELRNASLRMFGLRVEDEGNYTCLFVTFPQGSRSVDIWL

SEQ ID NO: 403 - protein, 116 aa, Artificial Sequence
  CD155 v4 IgV
PGTGDVVVQAPTQVPGFLGDSVTLPCYLQVPNMEVTHVSQLTWARHGESGSMVVFHQTQGPSYSESKRLEFVAARLGAELRNASLRMFGLRVEDEGNYTCLFVTFPQGSRSVDIWL

SEQ ID NO: 404 - protein, 116 aa, Artificial Sequence
  CD155 v5 IgV
PGTGDVVVQAPTQVLGFLGDSVTLPCYLQVPNMEVTHVSQLTWARHGESGSMAVFHQTQGPSYSESKRLEFVAARVGAELRNASLRMSGLRVEDEGNYTCLFVTFPQGSRSVDIWL

SEQ ID NO: 405 - protein, 116 aa, Artificial Sequence
  CD155 v6 IgV
PGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWL

SEQ ID NO: 406 - protein, 116 aa, Artificial Sequence
  CD155 v7 IgV
PGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWL

SEQ ID NO: 407 - protein, 116 aa, Artificial Sequence
  CD155 v8 IgV
PGTGDVVVQAPTQVTGFLGDSVTLPCYLQVPNMEVTHVPQLTWARHGESGSMAVFHQTQGPSYSESKRLEFVAARLGAELRNASLRMSGLRVEDEGNYTCLFVTFPQGSRSVDIWL

SEQ ID NO: 408 - protein, 116 aa, Artificial Sequence
  CD155 v9 IgV
PGTEDVVVQAPTQVTGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWL

SEQ ID NO: 409 - protein, 116 aa, Artificial Sequence
  CD155 v10 IgV
PGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQDSRSVDIWL

SEQ ID NO: 410 - protein, 116 aa, Artificial Sequence
  CD155 v11 IgV
PGTGDVVVQAPTQVSGFLGDSVTLPCYLQVPNMEVTHVSQLTWARHGESGSMAVFHQTQGPSYSESKRLEFVAARLGAELRNASLRMPGLRVEDEGNYTCLFVTFPQGSRSVDIWL

SEQ ID NO: 411 - protein, 116 aa, Artificial Sequence
  CD155 v12 IgV
PGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTLPQGSRSVDIWL

SEQ ID NO: 412 - protein, 116 aa, Artificial Sequence
  CD155 v14 IgV
PGTGDVVVQAPTQVTGFLGDSVTLPCYLQVPNMEVTHVSQLAWARHGESGSMAVFHQTQGPSYSESKRLEFVAARLGAELRNASLRMSGLRVEDEGNYTCLFVTFPQGSRSVDIWL

SEQ ID NO: 413 - protein, 116 aa, Artificial Sequence
  CD155 v15 IgV
PGTGDVVVQAPTQVTGFLGDSVTLPCYLQVPNMEVTHVSQLTWARHGESGSMAVFHQTQGPSYSESKRLEFVAARLGAELRNASLRMSGLHVEDEGNYTCLFVTFPQGSRSVDIWL

SEQ ID NO: 414 - protein, 116 aa, Artificial Sequence
  CD155 v16 IgV
PGTGDVVVQAPTQVSGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWL

SEQ ID NO: 415 - protein, 116 aa, Artificial Sequence
  CD155 v17 IgV
PGTGDVVVQAPTQVPGFLGDSVTLPCYLQVPNMEVTHVSQLTWARHGESGSMAVFHQTQGPSYSESKRLEFVAARLGVEPRNASLRMFGLRVEDEGNYTCLFVTFPQGSRSVDIWL

SEQ ID NO: 416 - protein, 116 aa, Artificial Sequence
  CD155 v18 IgV
PGTGDVVVQAPTQVPGFLGDSVTLPCYLQVPNMEVTHVSQLTWARHGESGSMAVFHQTQGPSYSESKRLEFVAARLGAELRNASPRMFGLRVEDEGNYTCLFVTFPQGSRSVDIWL

SEQ ID NO: 417 - protein, 116 aa, Artificial Sequence
  CD155 v19 IgV
PGTGDVVVQAPTQVPGFLGDSVTLPCYLQVPNMEVTHVSQLTWARHGESGSMAVFHQTQGPSYSESKRLEFVAARLGAELRNASLRMFGLHVEDEGNYTCLFVTFPQGSRSVDIWL

SEQ ID NO: 418 - protein, 116 aa, Artificial Sequence
  CD155 v20 IgV
PGTGDVVVQEPTQVSGFLGDSVTLPCYLQVPNMEVTHVSQLTWARHGESGSMVVFHQTQGPSYSESKRLEFVAARLGAELRNASLRMSGLRVEDEGNYTCLFVTFPQGSRSVDIWL

SEQ ID NO: 419 - protein, 116 aa, Artificial Sequence
  CD155 v21 IgV
PGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSADIWL

SEQ ID NO: 420 - protein, 116 aa, Artificial Sequence
  CD155 v22 IgV
PGTGDVVVQAPTQVTGFLGDSVTLPCYLQVPNMEVTHVSQLTWARHGESGSMAVFHKTQGPSYSESKRLEFVAARLGAELRNASLRMFGLRVEDEGNYTCLFVTFPQGSRSVDIWL

SEQ ID NO: 421 - protein, 122 aa, Homo sapiens
  MISC_FEATURE: CD155 IgV wildtype
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVL

SEQ ID NO: 422 - protein, 122 aa, Artificial Sequence
  CD155 v1 IgV
WPPPGTGDVVVQAPTQVSGFLGDSVTLPCYLQVPNMEVTHVSQLTWARHGESGSMAVFHQTQGSSYSESKRLEFVAARLGAELRNASLRMSGLRVEDEGNYTCLFVTFPQGSRSVDIWLRVL

SEQ ID NO: 423 - protein, 122 aa, Artificial Sequence
  CD155 v2 IgV
WPPPGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCPFVTFPQGSRSVDIWLRVL

SEQ ID NO: 424 - protein, 122 aa, Artificial Sequence
  CD155 v3 IgV
WPPPGTGDVVVQAPTQVPGFLGDSVTLPCYLQVPNMEVTHVSQPTWARHGESGSMAVFHQTQGPSYSESKRLEFVAARLGAELRNASLRMFGLRVEDEGNYTCLFVTFPQGSRSVDIWLRVL

SEQ ID NO: 425 - protein, 122 aa, Artificial Sequence
  CD155 v4 IgV
WPPPGTGDVVVQAPTQVPGFLGDSVTLPCYLQVPNMEVTHVSQLTWARHGESGSMVVFHQTQGPSYSESKRLEFVAARLGAELRNASLRMFGLRVEDEGNYTCLFVTFPQGSRSVDIWLRVL

SEQ ID NO: 426 - protein, 122 aa, Artificial Sequence
  CD155 v5 IgV
WPPPGTGDVVVQAPTQVLGFLGDSVTLPCYLQVPNMEVTHVSQLTWARHGESGSMAVFHQTQGPSYSESKRLEFVAARVGAELRNASLRMSGLRVEDEGNYTCLFVTFPQGSRSVDIWLRVL

SEQ ID NO: 427 - protein, 122 aa, Artificial Sequence
  CD155 v6 IgV
WPPPGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWLRVL

SEQ ID NO: 428 - protein, 122 aa, Artificial Sequence
  CD155 v7 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWLRVL

SEQ ID NO: 429 - protein, 122 aa, Artificial Sequence
  CD155 v8 IgV
WPPPGTGDVVVQAPTQVTGFLGDSVTLPCYLQVPNMEVTHVPQLTWARHGESGSMAVFHQTQGPSYSESKRLEFVAARLGAELRNASLRMSGLRVEDEGNYTCLFVTFPQGSRSVDIWLRVL

SEQ ID NO: 430 - protein, 122 aa, Artificial Sequence
  CD155 v9 IgV
WPPPGTEDVVVQAPTQVTGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWLRVL

SEQ ID NO: 431 - protein, 122 aa, Artificial Sequence
  CD155 v10 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQDSRSVDIWLRVL

SEQ ID NO: 432 - protein, 122 aa, Artificial Sequence
  CD155 v11 IgV
WPPPGTGDVVVQAPTQVSGFLGDSVTLPCYLQVPNMEVTHVSQLTWARHGESGSMAVFHQTQGPSYSESKRLEFVAARLGAELRNASLRMPGLRVEDEGNYTCLFVTFPQGSRSVDIWLRVL

SEQ ID NO: 433 - protein, 122 aa, Artificial Sequence
  CD155 v12 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTLPQGSRSVDIWLRVL

SEQ ID NO: 434 - protein, 122 aa, Artificial Sequence
  CD155 v14 IgV
WPPPGTGDVVVQAPTQVTGFLGDSVTLPCYLQVPNMEVTHVSQLAWARHGESGSMAVFHQTQGPSYSESKRLEFVAARLGAELRNASLRMSGLRVEDEGNYTCLFVTFPQGSRSVDIWLRVL

SEQ ID NO: 435 - protein, 122 aa, Artificial Sequence
  CD155 v15 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLHVEDEGNYTCLFVTFPQGSRSVDIWLRVL

SEQ ID NO: 436 - protein, 122 aa, Artificial Sequence
  CD155 v16 IgV
WPPPGTGDVVVQAPTQVSGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWLRVL

SEQ ID NO: 437 - protein, 122 aa, Artificial Sequence
  CD155 v17 IgV
WPPPGTGDVVVQAPTQVPGFLGDSVTLPCYLQVPNMEVTHVSQLTWARHGESGSMAVFHQTQGPSYSESKRLEFVAARLGVEPRNASLRMFGLRVEDEGNYTCLFVTFPQGSRSVDIWLRVL

SEQ ID NO: 438 - protein, 122 aa, Artificial Sequence
  CD155 v18 IgV
WPPPGTGDVVVQAPTQVPGFLGDSVTLPCYLQVPNMEVTHVSQLTWARHGESGSMAVFHQTQGPSYSESKRLEFVAARLGAELRNASPRMFGLRVEDEGNYTCLFVTFPQGSRSVDIWLRVL

SEQ ID NO: 439 - protein, 122 aa, Artificial Sequence
  CD155 v19 IgV
WPPPGTGDVVVQAPTQVPGFLGDSVTLPCYLQVPNMEVTHVSQLTWARHGESGSMAVFHQTQGPSYSESKRLEFVAARLGAELRNASLRMFGLHVEDEGNYTCLFVTFPQGSRSVDIWLRVL

SEQ ID NO: 440 - protein, 122 aa, Artificial Sequence
  CD155 v20 IgV
WPPPGTGDVVVQEPTQVSGFLGDSVTLPCYLQVPNMEVTHVSQLTWARHGESGSMVVFHQTQGPSYSESKRLEFVAARLGAELRNASLRMSGLRVEDEGNYTCLFVTFPQGSRSVDIWLRVL

SEQ ID NO: 441 - protein, 122 aa, Artificial Sequence
  CD155 v21 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSADIWLRVL

SEQ ID NO: 442 - protein, 122 aa, Artificial Sequence
  CD155 v22 IgV
WPPPGTGDVVVQAPTQVTGFLGDSVTLPCYLQVPNMEVTHVSQLTWARHGESGSMAVFHKTQGPSYSESKRLEFVAARLGAELRNASLRMFGLRVEDEGNYTCLFVTFPQGSRSVDIWLRVL

SEQ ID NO: 443 - protein, 323 aa, Artificial Sequence
  CD155 v23 ECD
WPPPGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 444 - protein, 323 aa, Artificial Sequence
  CD155 v24 ECD
WPPPGTGDVVVQAPTQVPGFLGDSVTLPCYLQVPNMEVTHVSQLQWARHGELGSMAVFHQTQGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 445 - protein, 323 aa, Artificial Sequence
  CD155 v25 ECD
WPPPGTGDVVVQAPTQVPGFLGDSVTLPCYLQVPNMEVTHVGQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 446 - protein, 323 aa, Artificial Sequence
  CD155 v26 ECD
WPPPGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 447 - protein, 323 aa, Artificial Sequence
  CD155 v27 ECD
WPPPGTGDVVVQAPTQVPGFLGDSVTLPCYLQVPNMEVTHVSQLTWARHGEQGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 448 - protein, 323 aa, Artificial Sequence
  CD155 v28 ECD
WPPPGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 449 - protein, 323 aa, Artificial Sequence
  CD155 v39 ECD
WPPPGTGDVVVQAPTQVPGFLGDSVTLPCYLQVPNMEVTHVAQLTWARHGEQGSMAVFHQTQGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 450 - protein, 323 aa, Artificial Sequence
  CD155 v30 ECD
WPPPGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 451 - protein, 323 aa, Artificial Sequence
  CD155 v31 ECD
WPPPGTGDVVVQAPTQVPGFLGDSVTLPCYLQVPNMEVTHVCQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 452 - protein, 323 aa, Artificial Sequence
  CD155 v32 ECD
WPPPGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 453 - protein, 323 aa, Artificial Sequence
  CD155 v33 ECD
WPPPGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 454 - protein, 323 aa, Artificial Sequence
  CD155 v34 ECD
WPPPGTGDVVVQAPTQVPGFLGDSVTLPCYLQVPNMEVTHVLQLTWARHGELGSMAVFHQTFGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 455 - protein, 323 aa, Artificial Sequence
  CD155 v35 ECD
WPPPGTGDVVVQAPTQVPGFLGDSVTLPCYLQVPNMEVTHVWQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 456 - protein, 323 aa, Artificial Sequence
  CD155 v36 ECD
WPPPGTGDVVVQAPTQVPGFLGDSVTLPCYLQVPNMEVTHVQQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 457 - protein, 323 aa, Artificial Sequence
  CD155 v37 ECD
WPPPGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 458 - protein, 323 aa, Artificial Sequence
  CD155 v38 ECD
WPPPGTGDVVVQAPTQVPGFLGDSVTLPCYLQVPNMEVTHVSQLTWARHGERGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 459 - protein, 323 aa, Artificial Sequence
  CD155 v39 ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 460 - protein, 323 aa, Artificial Sequence
  CD155 v40 ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 461 - protein, 323 aa, Artificial Sequence
  CD155 v41 ECD
WPPPGTGDVVVQAPTQVPGFLGDSVTLPCYLQVPNMEVTHVSQLTWARHGEEGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 462 - protein, 323 aa, Artificial Sequence
  CD155 v42 ECD
WPPPGTGDVVVQAPTQVPGFLGDSVTLPCYLQVPNMEVTHVSQLTWARHGESGSMAVFHQTYGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 463 - protein, 323 aa, Artificial Sequence
  CD155 v43 ECD
WPPPGTGDVVVQAPTQVPGFLGDSVTLPCYLQVPNMEVTHVSQLQWARHGEMGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 464 - protein, 323 aa, Artificial Sequence
  CD155 v44 ECD
WPPPGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 465 - protein, 323 aa, Artificial Sequence
  CD155 v45 ECD
WPPPGTGDVVVQAPTQVPGFLGDSVTLPCYLQVPNMEVTHVSQLTWARHGEMGSMALFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 466 - protein, 323 aa, Artificial Sequence
  CD155 v46 ECD
WPPPGTGDVVVQAPTQVPGFLGDSVTLPCYLQVPNMEVTHVNQLTWARHGEQGSMAVFHQTFGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 467 - protein, 323 aa, Artificial Sequence
  CD155 v47 ECD
WPPPGTGDVVVQAPTQVPGFLGDSVTLPCYLQVPNMEVTHVAQLTWARHGELGSMAVFHQTQGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 468 - protein, 323 aa, Artificial Sequence
  CD155 v48 ECD
WPPPGTGDVVVQAPTQVPGFLGDSVTLPCYLQVPNMEVTHVWQLTWARHGEQGSMALFHQTYGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 469 - protein, 323 aa, Artificial Sequence
  CD155 v49 ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 470 - protein, 323 aa, Artificial Sequence
  CD155 v50 ECD
WPPPGTGDVVVQAPTQVPGFLGDSVTLPCYLQVPNMEVTHVLQLTWARHGEQGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 471 - protein, 323 aa, Artificial Sequence
  CD155 v51 ECD
WPPPGTGDVVVQAPTQVPGFLGDSVTLPCYLQVPNMEVTHVCQLTWARHGELGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 472 - protein, 323 aa, Artificial Sequence
  CD155 v52 ECD
WPPPGTGDVVVQAPTQVPGFLGDSVTLPCYLQVPNMEVTHVWQLTWARHGERGSMAVFHQTYGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 473 - protein, 323 aa, Artificial Sequence
  CD155 v53 ECD
WPPPGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 474 - protein, 323 aa, Artificial Sequence
  CD155 v54 ECD
WPPPGTGDVVVQAPTQVPGFLGDSVTLPCYLQVPNMEVTHVSQLTWARHGERGSMAVFHQTFGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 475 - protein, 323 aa, Artificial Sequence
  CD155 v55 ECD
WPPPGTGDVVVQAPTQVPGFLGDSVTLPCYLQVPNMEVTHVSQLQWARHGELGSMALFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 476 - protein, 323 aa, Artificial Sequence
  CD155 v56 ECD
WPPPGTGDVVVQAPTQVPGFLGDSVTLPCYLQVPNMEVTHVSQLTWARHGEMGSMAVFHQTYGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 477 - protein, 323 aa, Artificial Sequence
  CD155 v57 ECD
WPPPGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 478 - protein, 323 aa, Artificial Sequence
  CD155 v58 ECD
WPPPGTGDVVVQAPTQVPGFLGDSVTLPCYLQVPNMEVTHVSQLQWARHGEQGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 479 - protein, 323 aa, Artificial Sequence
  CD155 v59 ECD
WPPPGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 480 - protein, 323 aa, Artificial Sequence
  CD155 v60 ECD
WPPPGTGDVVVQAPTQVPGFLGDSVTLPCYLQVPNMEVTHVVQLTWARHGEEGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 481 - protein, 323 aa, Artificial Sequence
  CD155 v61 ECD
WPPPGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 482 - protein, 323 aa, Artificial Sequence
  CD155 v62 ECD
WPPPGTGDVVVQAPTQVPGFLGDSVTLPCYLQVPNMEVTHVGQLTWARHGEQGSMAVFHQTQGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 483 - protein, 323 aa, Artificial Sequence
  CD155 v63 ECD
WPPPGTGDVVVQAPTQVPGFLGDSVTLPCYLQVPNMEVTHVNQLTWARHGEEGSMALFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 484 - protein, 323 aa, Artificial Sequence
  CD155 v64 ECD
WPPPGTGDVVVQAPTQVPGFLGDSVTLPCYLQVPNMEVTHVCQLTWARHGEMGSMAVFHQTFGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 485 - protein, 323 aa, Artificial Sequence
  CD155 v65 ECD
WPPPGTGDVVVQAPTQVPGFLGDSVTLPCYLQVPNMEVTHVLQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 486 - protein, 323 aa, Artificial Sequence
  CD155 v66 ECD
WPPPGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 487 - protein, 323 aa, Artificial Sequence
  CD155 v67 ECD
WPPPGTGDVVVQAPTQVPGFLGDSVTLPCYLQVPNMEVTHVGQLTWARHGELGSMAVFHQTFGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 488 - protein, 323 aa, Artificial Sequence
  CD155 v68 ECD
WPPPGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 489 - protein, 323 aa, Artificial Sequence
  CD155 v69 ECD
WPPPGTGDVVVQAPTQVTGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 490 - protein, 323 aa, Artificial Sequence
  CD155 v70 ECD
WPPPGTGDVVVQAPTQVFGFLGDSVTLPCYLQVPNMEVAHVSQLQWARHGESGSMAVFHQRQGPNYLESKRLGFVAAGLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 491 - protein, 323 aa, Artificial Sequence
  CD155 v71 ECD
WPPPGTGDVVVQAPTQVTGFLGDSVTLPCYLQVPNMEVTHVSQLQWARHGESGSMAVFHQRQGPNYLESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 492 - protein, 323 aa, Artificial Sequence
  CD155 v72 ECD
WPPPGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 493 - protein, 323 aa, Artificial Sequence
  CD155 v73 ECD
WPPPGTGDVVVQAPTQVFGFLGDSVTLPCYLQVPNMEVTHVSQLQWARHGESGSMAVFHQRQGPNYLESKRLEFVAARLGAELRNASLRMSGLRVEDEGNYTCPFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 494 - protein, 323 aa, Artificial Sequence
  CD155 v74 ECD
WPPPGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 495 - protein, 323 aa, Artificial Sequence
  CD155 v75 ECD
WPPPGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 496 - protein, 323 aa, Artificial Sequence
  CD155 v76 ECD
WPPPGTGDVVVQAPTQVPGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 497 - protein, 323 aa, Artificial Sequence
  CD155 v77 ECD
WPPPGTGDVVVQAPTQVTGFLGDSVTLPCYLQVPNMEVTHVSQLQWARHGESGSMAVFHQTQGPSYSESKRLEFVAARPGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 498 - protein, 323 aa, Artificial Sequence
  CD155 v78 ECD
WPPPGTGDVVVQAPTQVTGFLGDSVTLPCYLQVPNMEVTHVSQLQWARHGESGSMAVFHQRQGPHYHESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 499 - protein, 323 aa, Artificial Sequence
  CD155 v79 ECD
WPPPGTGDVVVQAPTQVTGFLGDSVTLPCYLQVPNMEVTHVSQLTWARHGESGSMAVFHQTQGPSYSESKRLEFVAARLGEELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 500 - protein, 323 aa, Artificial Sequence
  CD155 v80 ECD
WPPPGTGDVVVQAPTQVSGFLGYSVTLPCYLQVPNMPVTHVSQLTWARHGEGGSMAVFHQTMGPSYSESKRLEFVAARLSPELRNASLRMFGLRVEDEYNYTCLFVTFPQGNRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 501 - protein, 323 aa, Artificial Sequence
  CD155 v81 ECD
WPPPGTGDVVVQRPTQVPGFLGYSVTLPCYLQVPNMPVTHVPQLTWARHGESGSMAVFHQTYGPSYSESKRLEFVAARLGEELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 502 - protein, 323 aa, Artificial Sequence
  CD155 v82 ECD
WPPPGTGDVVVQRPTQVPGFLGYSVTLPCYLQVPNMPVTHVSQLTWARHGESGSMAVFHQTQGPSYSESKRLEFVAARLGAELRNASLRMFGLRVEDEYNYTCLFVTFPQGNRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 503 - protein, 323 aa, Artificial Sequence
  CD155 v83 ECD
WPPPGTGDVVVQRPTQVPGFLGYSVTLPCYLQVPNMPVTHVSQLTWARHGESGSMAVFHQTMGPSYSESKRLEFVAVRLSPELRNASLRMFGLRVEDEYNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 504 - protein, 323 aa, Artificial Sequence
  CD155 v84 ECD
WPPPGTGDVVVQAPTQVLGFLGDSVTLPCYLQVPNMSVTHVSQLTWARHGESGSMAVFHQTMGPSYSESKRLEFVAARLSPELRNASLRMFGLRVEDEYNYTCLFVTFPQGNRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 505 - protein, 323 aa, Artificial Sequence
  CD155 v85 ECD
WPPPGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 506 - protein, 323 aa, Artificial Sequence
  CD155 v86 ECD
WPPPGTGDVVVQAPTQVSGFLGDSVTLPCYLQVPNMEVTHVSQLTWARHGESGSMAVFHQTHGPSYSESKRLEFVAARQGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 507 - protein, 323 aa, Artificial Sequence
  CD155 v87 ECD
WPPPGTGDVVVQAPTQVPGFLGDSVTLPCYLQVPNMEVTHVSQLQWARHGEKGSMAVFHQTFGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 508 - protein, 323 aa, Artificial Sequence
  CD155 v88 ECD
WPPPGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 509 - protein, 323 aa, Artificial Sequence
  CD155 v89 ECD
WPPPGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 510 - protein, 323 aa, Artificial Sequence
  CD155 v90 ECD
WPPPGTGDVVVQAPTQVPGFLGDSVTLPCYLQVPNMEVTHVSQLTWARHGESGSMAAFHQMQGPWYAESKRLEFVAARLGAELRNASLRMFGLRVDDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 511 - protein, 323 aa, Artificial Sequence
  CD155 v91 ECD
WPPPGTGDVVVQAPTQVLGFLGDSVTLPCYLQVPNMEVTHVSQLTWARHGESGSMATFHQSQGPYYAESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 512 - protein, 323 aa, Artificial Sequence
  CD155 v92 ECD
WPPPGTGDVVVQAPTQVTGFLGDSVTLPCYLQVPNMEVTHVSQLQWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 513 - protein, 323 aa, Artificial Sequence
  CD155 v94 ECD
WPPPGTGDVVVQAPTQVLGFLGDSVTLPCYLQVPNMEVTHVSQLTWARHGESGSMAAFHQMQGPWYAESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 514 - protein, 323 aa, Artificial Sequence
  CD155 v94 ECD
WPPPGTGDVVVQAPTQVPGFLGDSVTLPCYLQVPNMEVTHVSQLTWARHGESGSMAVFHQMQGPWYAESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 515 - protein, 323 aa, Artificial Sequence
  CD155 v94 ECD
WPPPGTGDVVVQAPTQVSGFLGDSVTLPCYLQVPNMEVTHAGQLGWARHGESGSMAVFHQTQGPSYSESKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 516 - protein, 323 aa, Artificial Sequence
  CD155 v96 ECD
WPPPGTGDVVVQAPTQVHGFLGDSVTLPCYLQVPNMEVTHVGQLIWARHGETRHMALFEQSQGPDYSGSKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 517 - protein, 323 aa, Artificial Sequence
  CD155 v97 ECD
WPPPGTGDVVVQAPTQVSGFLGDSVTLPCYLQVPNMEVTHVGQLVWARHGESGSMAVLHQTQGPSYWESKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 518 - protein, 323 aa, Artificial Sequence
  CD155 v98 ECD
WPPPGTGDVVVQAPTQVSGFLGDSVTLPCYLQVPNMEVTHVSQLIWARHGESGSMAVFHQTQGPSYSESKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 519 - protein, 323 aa, Artificial Sequence
  CD155 v99 ECD
WPPPGTGDVVVQAPTQVSGFLGDSVTLPCYLQVPNMEVTHVGQLGWARHGESGSMAVFHQTQGPSYSESKRLEFVAARLGAELRNASLRMFGLRVEDEGNYTCNFATFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 520 - protein, 323 aa, Artificial Sequence
  CD155 v100 ECD
WPPPGTGDVVVQAPTQVHGFLGDSVTLPCYLQVPNMEVTRVGQLIWARHGETRHMALFEQSQGPDYSGSKRLEFVAARLGAELRNASLRMFGLRVEDEGNYTCYFLTHPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 521 - protein, 323 aa, Artificial Sequence
  CD155 v101 ECD
WPPPGTGDVVVQAPTQVPGFLGDSVTLPCYLQVPNMVVTHVGQLGWARHGESGSMAVFHQTQGPSYSESKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 522 - protein, 323 aa, Artificial Sequence
  CD155 v102 ECD
WPPPGTGDVVVQAPTQVSGFLGDSVTLPCYLQVPNMEVTHVSQLQWARHGESGSMAVFHQTQGPSYSESKRLEFVAARPGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 523 - protein, 323 aa, Artificial Sequence
  CD155 v103 ECD
WPPPGTGDVVVQAPTQVLGFLGDSVTLPCYLQVPNMEVTHVSQLTWARHGESGSMAVFHQTRGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 524 - protein, 323 aa, Artificial Sequence
  CD155 v104 ECD
WPPPGTGDVVVQRPTQVPGFLGYSVTLPCYLQVPNMPVTHVLQLTWARHGEGGSMAVFHQTYGPSYSESKRLEFVAARLGEELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 525 - protein, 323 aa, Artificial Sequence
  CD155 v105 ECD
WPPPGTGDVVVQAPTQVLGFLGDSVTLPCYLQVPNMEVTHVSQLTWARRGESGSMAVFHQTQGPSYSESKRLEFVAARLGAELRNASLRMFGLRVEDEGNYTCTFVTFPQGSRSVNIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 526 - protein, 323 aa, Artificial Sequence
  CD155 v106 ECD
WPPPGTGDVVVQRPTQVPGFLGYSVTLPCYLQVPNMPVTHVSQLTWARHGESGSMAVFHQTMGPSYSESKRLEFVAARLSPELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 527 - protein, 323 aa, Artificial Sequence
  CD155 v107 ECD
WPPPGTGDVVVQAPTQVPGFLGDSVTLPCYLQVPNMEVTHVSQLTWARHGESGSMAVFHQTQGPTYSESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 528 - protein, 323 aa, Artificial Sequence
  CD155 v108 ECD
WPPPGTGDVVVQRPTQVPGFLGYSVTLPCYLQVPNMPVTHVSQLTWARHGEGGSMAAFHQTMGPSYSESERLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 529 - protein, 323 aa, Artificial Sequence
  CD155 v109 ECD
WPPPGTGDVVVQAPTQVLGFLGDSVTLPCYLQVPNMEVTHVSQLTWVRHGESGSMAVFHQTYGPSYSESKRLDFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 530 - protein, 323 aa, Artificial Sequence
  CD155 v110 ECD
WPPPGTGDVVVQAPTQVPGFLGDSVTLPCYLQVPNMEVTTMSQLTWVRHGEQGSMAVFHQTLGPTYSESKRLRFVAARLGAELRNASLRMFGLRVEGSGNYTCTFVTFPQGSRSVNIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 531 - protein, 323 aa, Artificial Sequence
  CD155 v111 ECD
WPPPGTGDVVVQAPTQVLGFLGDSVTLPCYLQVPNMEVTHVPQLQWARHGESGSMAVFHQGQGPHYEESKRLEFVAARLGAELRNASLRMFGLRVEDEGNYTCTFVTFPQGSRSVNIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 532 - protein, 323 aa, Artificial Sequence
  CD155 v112 ECD
WPPPGTGDVVVQAPTQVSGFLGDSVTLPCYLQVPNMEVTTMSQLTWVRHGEQGSMAVFHQTLGPTYSESKRLRFVAARLGAELRNASLRMFGLRVEDEGNYTCMFATFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 533 - protein, 323 aa, Artificial Sequence
  CD155 v113 ECD
WPPPGTGDVVVQAPTQVPGFLGDSVTLPCYLQVPNMEVTTMSQLTWVRHGEQGSMAVFHQTLGPTYSGSKRLRFVAARLGAELRNASLRMFGLRVEGSGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 534 - protein, 323 aa, Artificial Sequence
  CD155 v114 ECD
WPPPGTGDVVVQAPTQVPGFLGDSVTLPCYLQVPNMEVTHVSQLQWARHGEEGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 535 - protein, 323 aa, Artificial Sequence
  CD155 v115 ECD
WPPPGTGDVVVQAPTQVPGFLGDSVTLPCYLQVPNMEVTHVSQLQWARHGEEGSMAVFHQTFGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 536 - protein, 323 aa, Artificial Sequence
  CD155 v116 ECD
WPPPGTGDVVVQAPTQVFGFLGDSVMLPCYLQVPNMEVTHVSQVTWARHGESGSMAVFHQTKGPSYSESKRLEFVAARPGAELRNASLRMSGLRVEDEGNYTCMFVTFPQDSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 537 - protein, 323 aa, Artificial Sequence
  CD155 v117 ECD
WPPPGTGDVVVQAPTQVSGFLGDSVTLPCYLQVPNMEVTHVSQLSWARHGESGSMAVFHQKQGPWYAESKRLEFVAARLGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 538 - protein, 323 aa, Artificial Sequence
  CD155 v118 ECD
WPPPGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 539 - protein, 323 aa, Artificial Sequence
  CD155 v119 ECD
WPPPGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 540 - protein, 116 aa, Artificial Sequence
  CD155 v23 IgV
PGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCLFVTFPQGSRSVDIWL

SEQ ID NO: 541 - protein, 116 aa, Artificial Sequence
  CD155 v24 IgV
PGTGDVVVQAPTQVPGFLGDSVTLPCYLQVPNMEVTHVSQLQWARHGELGSMAVFHQTQGPSYSESKRLEFVAARLGAELRNASLRMFGLRVEDEGNYTCEFVTFPQRSRSVDIWL

SEQ ID NO: 542 - protein, 116 aa, Artificial Sequence
  CD155 v25 IgV
PGTGDVVVQAPTQVPGFLGDSVTLPCYLQVPNMEVTHVGQLTWARHGESGSMAVFHQTQGPSYSESKRLEFVAARLGAELRNASLRMFGLRVEDEGNYTCLFVTFPQGSRSVDIWL

SEQ ID NO: 543 - protein, 116 aa, Artificial Sequence
  CD155 v26 IgV
PGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCLFVTFPQGSRSVDIWL

SEQ ID NO: 544 - protein, 119 aa, Artificial Sequence
  CD155 v27 IgV
PGTGDVVVQAPTQVPGFLGDSVTLPCYLQVPNMEVTHVSQLTWARHGEQGSMAVFHQTQGPSYSESKRLEFVAARLGAELRNASLRMFGLRVEDEGNYTCLFVTFPQGSRSVDIWLRVL

SEQ ID NO: 545 - protein, 116 aa, Artificial Sequence
  CD155 v28 IgV
PGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCQFVTFPQRSRSVDIWL

SEQ ID NO: 546 - protein, 116 aa, Artificial Sequence
  CD155 v29 IgV
PGTGDVVVQAPTQVPGFLGDSVTLPCYLQVPNMEVTHVAQLTWARHGEQGSMAVFHQTQGPSYSESKRLEFVAARLGAELRNASLRMFGLRVEDEGNYTCQFVTFPQRSRSVDIWL

SEQ ID NO: 547 - protein, 116 aa, Artificial Sequence
  CD155 v30 IgV
PGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCEFVTFPQGSRSVDIWL

SEQ ID NO: 548 - protein, 116 aa, Artificial Sequence
  CD155 v31 IgV
PGTGDVVVQAPTQVPGFLGDSVTLPCYLQVPNMEVTHVCQLTWARHGESGSMAVFHQTQGPSYSESKRLEFVAARLGAELRNASLRMFGLRVEDEGNYTCLFVTFPQGSRSVDIWL

SEQ ID NO: 549 - protein, 116 aa, Artificial Sequence
  CD155 v32 IgV
PGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCLFVTFPQGSRSVDIWL

SEQ ID NO: 550 - protein, 116 aa, Artificial Sequence
  CD155 v33 IgV
PGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCQFVTFPQGSRSVDIWL

SEQ ID NO: 551 - protein, 116 aa, Artificial Sequence
  CD155 v34 IgV
PGTGDVVVQAPTQVPGFLGDSVTLPCYLQVPNMEVTHVLQLTWARHGELGSMAVFHQTFGPSYSESKRLEFVAARLGAELRNASLRMFGLRVEDEGNYTCQFVTFPQGSRSVDIWL

SEQ ID NO: 552 - protein, 116 aa, Artificial Sequence
  CD155 v35 IgV
PGTGDVVVQAPTQVPGFLGDSVTLPCYLQVPNMEVTHVWQLTWARHGESGSMAVFHQTQGPSYSESKRLEFVAARLGAELRNASLRMFGLRVEDEGNYTCLFVTFPQGSRSVDIWL

SEQ ID NO: 553 - protein, 116 aa, Artificial Sequence
  CD155 v36 IgV
PGTGDVVVQAPTQVPGFLGDSVTLPCYLQVPNMEVTHVQQLTWARHGESGSMAVFHQTQGPSYSESKRLEFVAARLGAELRNASLRMFGLRVEDEGNYTCLFVTFPQGSRSVDIWL

SEQ ID NO: 554 - protein, 116 aa, Artificial Sequence
  CD155 v37 IgV
PGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCLFVTFPQGSRSVDIWL

SEQ ID NO: 555 - protein, 116 aa, Artificial Sequence
  CD155 v38 IgV
PGTGDVVVQAPTQVPGFLGDSVTLPCYLQVPNMEVTHVSQLTWARHGERGSMAVFHQTQGPSYSESKRLEFVAARLGAELRNASLRMFGLRVEDEGNYTCLFVTFPQGSRSVDIWL

SEQ ID NO: 556 - protein, 116 aa, Artificial Sequence
  CD155 v39 IgV
PGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCEFVTFPQGSRSVDIWL

SEQ ID NO: 557 - protein, 116 aa, Artificial Sequence
  CD155 v40 IgV
PGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQRSRSVDIWL

SEQ ID NO: 558 - protein, 116 aa, Artificial Sequence
  CD155 v41 IgV
PGTGDVVVQAPTQVPGFLGDSVTLPCYLQVPNMEVTHVSQLTWARHGEEGSMAVFHQTQGPSYSESKRLEFVAARLGAELRNASLRMFGLRVEDEGNYTCLFVTFPQGSRSVDIWL

SEQ ID NO: 559 - protein, 116 aa, Artificial Sequence
  CD155 v42 IgV
PGTGDVVVQAPTQVPGFLGDSVTLPCYLQVPNMEVTHVSQLTWARHGESGSMAVFHQTYGPSYSESKRLEFVAARLGAELRNASLRMFGLRVEDEGNYTCLFVTFPQGSRSVDIWL

SEQ ID NO: 560 - protein, 116 aa, Artificial Sequence
  CD155 v43 IgV
PGTGDVVVQAPTQVPGFLGDSVTLPCYLQVPNMEVTHVSQLQWARHGEMGSMAVFHQTQGPSYSESKRLEFVAARLGAELRNASLRMFGLRVEDEGNYTCEFVTFPQGSRSVDIWL

SEQ ID NO: 561 - protein, 116 aa, Artificial Sequence
  CD155 v44 IgV
PGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCQFVTFPQRSRSVDIWL

SEQ ID NO: 562 - protein, 116 aa, Artificial Sequence
  CD155 v45 IgV
PGTGDVVVQAPTQVPGFLGDSVTLPCYLQVPNMEVTHVSQLTWARHGEMGSMALFHQTQGPSYSESKRLEFVAARLGAELRNASLRMFGLRVEDEGNYTCLFVTFPQGSRSVDIWL

SEQ ID NO: 563 - protein, 116 aa, Artificial Sequence
  CD155 v46 IgV
PGTGDVVVQAPTQVPGFLGDSVTLPCYLQVPNMEVTHVNQLTWARHGEQGSMAVFHQTFGPSYSESKRLEFVAARLGAELRNASLRMFGLRVEDEGNYTCLFVTFPQGSRSVDIWL

SEQ ID NO: 564 - protein, 116 aa, Artificial Sequence
  CD155 v47 IgV
PGTGDVVVQAPTQVPGFLGDSVTLPCYLQVPNMEVTHVAQLTWARHGELGSMAVFHQTQGPSYSESKRLEFVAARLGAELRNASLRMFGLRVEDEGNYTCEFVTFPQRSRSVDIWL

SEQ ID NO: 565 - protein, 116 aa, Artificial Sequence
  CD155 v48 IgV
PGTGDVVVQAPTQVPGFLGDSVTLPCYLQVPNMEVTHVWQLTWARHGEQGSMALFHQTYGPSYSESKRLEFVAARLGAELRNASLRMFGLRVEDEGNYTCLFVTFPQGSRSVDIWL

SEQ ID NO: 566 - protein, 116 aa, Artificial Sequence
  CD155 v49 IgV
PGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCQFVTFPQGSRSVDIWL

SEQ ID NO: 567 - protein, 116 aa, Artificial Sequence
  CD155 v50 IgV
PGTGDVVVQAPTQVPGFLGDSVTLPCYLQVPNMEVTHVLQLTWARHGEQGSMAVFHQTQGPSYSESKRLEFVAARLGAELRNASLRMFGLRVEDEGNYTCEFVTFPQGSRSVDIWL

SEQ ID NO: 568 - protein, 116 aa, Artificial Sequence
  CD155 v51 IgV
PGTGDVVVQAPTQVPGFLGDSVTLPCYLQVPNMEVTHVCQLTWARHGELGSMAVFHQTQGPSYSESKRLEFVAARLGAELRNASLRMFGLRVEDEGNYTCLFVTFPQGSRSVDIWL

SEQ ID NO: 569 - protein, 116 aa, Artificial Sequence
  CD155 v52 IgV
PGTGDVVVQAPTQVPGFLGDSVTLPCYLQVPNMEVTHVWQLTWARHGERGSMAVFHQTYGPSYSESKRLEFVAARLGAELRNASLRMFGLRVEDEGNYTCQFVTFPQGSRSVDIWL

SEQ ID NO: 570 - protein, 116 aa, Artificial Sequence
  CD155 v53 IgV
PGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCEFVTFPQGSRSVDIWL

SEQ ID NO: 571 - protein, 116 aa, Artificial Sequence
  CD155 v54 IgV
PGTGDVVVQAPTQVPGFLGDSVTLPCYLQVPNMEVTHVSQLTWARHGERGSMAVFHQTFGPSYSESKRLEFVAARLGAELRNASLRMFGLRVEDEGNYTCQFVTFPQRSRSVDIWL

SEQ ID NO: 572 - protein, 116 aa, Artificial Sequence
  CD155 v55 IgV
PGTGDVVVQAPTQVPGFLGDSVTLPCYLQVPNMEVTHVSQLQWARHGELGSMALFHQTQGPSYSESKRLEFVAARLGAELRNASLRMFGLRVEDEGNYTCEFVTFPQGSRSVDIWL

SEQ ID NO: 573 - protein, 116 aa, Artificial Sequence
  CD155 v56 IgV
PGTGDVVVQAPTQVPGFLGDSVTLPCYLQVPNMEVTHVSQLTWARHGEMGSMAVFHQTYGPSYSESKRLEFVAARLGAELRNASLRMFGLRVEDEGNYTCLFVTFPQGSRSVDIWL

SEQ ID NO: 574 - protein, 116 aa, Artificial Sequence
  CD155 v57 IgV
PGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCEFVTFPQRSRSVDIWL

SEQ ID NO: 575 - protein, 116 aa, Artificial Sequence
  CD155 v58 IgV
PGTGDVVVQAPTQVPGFLGDSVTLPCYLQVPNMEVTHVSQLQWARHGEQGSMAVFHQTQGPSYSESKRLEFVAARLGAELRNASLRMFGLRVEDEGNYTCLFVTFPQGSRSVDIWL

SEQ ID NO: 576 - protein, 116 aa, Artificial Sequence
  CD155 v59 IgV
PGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCEFVTFPQGSRSVDIWL

SEQ ID NO: 577 - protein, 116 aa, Artificial Sequence
  CD155 v60 IgV
PGTGDVVVQAPTQVPGFLGDSVTLPCYLQVPNMEVTHVVQLTWARHGEEGSMAVFHQTQGPSYSESKRLEFVAARLGAELRNASLRMFGLRVEDEGNYTCLFVTFPQGSRSVDIWL

SEQ ID NO: 578 - protein, 116 aa, Artificial Sequence
  CD155 v61 IgV
PGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCLFVTFPQRSRSVDIWL

SEQ ID NO: 579 - protein, 116 aa, Artificial Sequence
  CD155 v62 IgV
PGTGDVVVQAPTQVPGFLGDSVTLPCYLQVPNMEVTHVGQLTWARHGEQGSMAVFHQTQGPSYSESKRLEFVAARLGAELRNASLRMFGLRVEDEGNYTCEFVTFPQRSRSVDIWL

SEQ ID NO: 580 - protein, 116 aa, Artificial Sequence
  CD155 v63 IgV
PGTGDVVVQAPTQVPGFLGDSVTLPCYLQVPNMEVTHVNQLTWARHGEEGSMALFHQTQGPSYSESKRLEFVAARLGAELRNASLRMFGLRVEDEGNYTCEFVTFPQGSRSVDIWL

SEQ ID NO: 581 - protein, 116 aa, Artificial Sequence
  CD155 v64 IgV
PGTGDVVVQAPTQVPGFLGDSVTLPCYLQVPNMEVTHVCQLTWARHGEMGSMAVFHQTFGPSYSESKRLEFVAARLGAELRNASLRMFGLRVEDEGNYTCLFVTFPQGSRSVDIWL

SEQ ID NO: 582 - protein, 116 aa, Artificial Sequence
  CD155 v65 IgV
PGTGDVVVQAPTQVPGFLGDSVTLPCYLQVPNMEVTHVLQLTWARHGESGSMAVFHQTQGPSYSESKRLEFVAARLGAELRNASLRMFGLRVEDEGNYTCLFVTFPQGSRSVDIWL

SEQ ID NO: 583 - protein, 116 aa, Artificial Sequence
  CD155 v66 IgV
PGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCLFVTFPQGSRSVDIWL

SEQ ID NO: 584 - protein, 116 aa, Artificial Sequence
  CD155 v67 IgV
PGTGDVVVQAPTQVPGFLGDSVTLPCYLQVPNMEVTHVGQLTWARHGELGSMAVFHQTFGPSYSESKRLEFVAARLGAELRNASLRMFGLRVEDEGNYTCQFVTFPQGSRSVDIWL

SEQ ID NO: 585 - protein, 116 aa, Artificial Sequence
  CD155 v68 IgV
PGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCLFVTFPQGSRSVDIWL

SEQ ID NO: 586 - protein, 116 aa, Artificial Sequence
  CD155 v69 IgV
PGTGDVVVQAPTQVTGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWL

SEQ ID NO: 587 - protein, 116 aa, Artificial Sequence
  CD155 v70 IgV
PGTGDVVVQAPTQVFGFLGDSVTLPCYLQVPNMEVAHVSQLQWARHGESGSMAVFHQRQGPNYLESKRLGFVAAGLGAELRNASLRMFGLRVEDEGNYTCLFVTFPQGSRSVDIWL

SEQ ID NO: 588 - protein, 116 aa, Artificial Sequence
  CD155 v71 IgV
PGTGDVVVQAPTQVTGFLGDSVTLPCYLQVPNMEVTHVSQLQWARHGESGSMAVFHQRQGPNYLESKRLEFVAARLGAELRNASLRMFGLRVEDEGNYTCLFVTFPQGSRSVDIWL

SEQ ID NO: 589 - protein, 116 aa, Artificial Sequence
  CD155 v72 IgV
PGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWL

SEQ ID NO: 590 - protein, 116 aa, Artificial Sequence
  CD155 v73 IgV
PGTGDVVVQAPTQVFGFLGDSVTLPCYLQVPNMEVTHVSQLQWARHGESGSMAVFHQRQGPNYLESKRLEFVAARLGAELRNASLRMSGLRVEDEGNYTCPFVTFPQGSRSVDIWL

SEQ ID NO: 591 - protein, 116 aa, Artificial Sequence
  CD155 v74 IgV
PGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWL

SEQ ID NO: 592 - protein, 116 aa, Artificial Sequence
  CD155 v75 IgV
PGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCMFVTFPQGSRSVDIWL

SEQ ID NO: 593 - protein, 116 aa, Artificial Sequence
  CD155 v76 IgV
PGTGDVVVQAPTQVPGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWL

SEQ ID NO: 594 - protein, 116 aa, Artificial Sequence
  CD155 v77 IgV
PGTGDVVVQAPTQVTGFLGDSVTLPCYLQVPNMEVTHVSQLQWARHGESGSMAVFHQTQGPSYSESKRLEFVAARPGAELRNASLRMFGLRVEDEGNYTCLFVTFPQGSRSVDIWL

SEQ ID NO: 595 - protein, 116 aa, Artificial Sequence
  CD155 v78 IgV
PGTGDVVVQAPTQVTGFLGDSVTLPCYLQVPNMEVTHVSQLQWARHGESGSMAVFHQRQGPHYHESKRLEFVAARLGAELRNASLRMFGLRVEDEGNYTCLFVTFPQGSRSVDIWL

SEQ ID NO: 596 - protein, 116 aa, Artificial Sequence
  CD155 v79 IgV
PGTGDVVVQAPTQVTGFLGDSVTLPCYLQVPNMEVTHVSQLTWARHGESGSMAVFHQTQGPSYSESKRLEFVAARLGEELRNASLRMFGLRVEDEGNYTCLFVTFPQGSRSVDIWL

SEQ ID NO: 597 - protein, 116 aa, Artificial Sequence
  CD155 v80 IgV
PGTGDVVVQAPTQVSGFLGYSVTLPCYLQVPNMPVTHVSQLTWARHGEGGSMAVFHQTMGPSYSESKRLEFVAARLSPELRNASLRMFGLRVEDEYNYTCLFVTFPQGNRSVDIWL

SEQ ID NO: 598 - protein, 116 aa, Artificial Sequence
  CD155 v81 IgV
PGTGDVVVQRPTQVPGFLGYSVTLPCYLQVPNMPVTHVPQLTWARHGESGSMAVFHQTYGPSYSESKRLEFVAARLGEELRNASLRMFGLRVEDEGNYTCLFVTFPQGSRSVDIWL

SEQ ID NO: 599 - protein, 116 aa, Artificial Sequence
  CD155 v82 IgV
PGTGDVVVQRPTQVPGFLGYSVTLPCYLQVPNMPVTHVSQLTWARHGESGSMAVFHQTQGPSYSESKRLEFVAARLGAELRNASLRMFGLRVEDEYNYTCLFVTFPQGNRSVDIWL

SEQ ID NO: 600 - protein, 116 aa, Artificial Sequence
  CD155 v83 IgV
PGTGDVVVQRPTQVPGFLGYSVTLPCYLQVPNMPVTHVSQLTWARHGESGSMAVFHQTMGPSYSESKRLEFVAVRLSPELRNASLRMFGLRVEDEYNYTCLFVTFPQGSRSVDIWL

SEQ ID NO: 601 - protein, 116 aa, Artificial Sequence
  CD155 v84 IgV
PGTGDVVVQAPTQVLGFLGDSVTLPCYLQVPNMSVTHVSQLTWARHGESGSMAVFHQTMGPSYSESKRLEFVAARLSPELRNASLRMFGLRVEDEYNYTCLFVTFPQGNRSVDIWL

SEQ ID NO: 602 - protein, 116 aa, Artificial Sequence
  CD155 v85 IgV
PGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCTFVTFPQGSRSVDIWL

SEQ ID NO: 603 - protein, 116 aa, Artificial Sequence
  CD155 v86 IgV
PGTGDVVVQAPTQVSGFLGDSVTLPCYLQVPNMEVTHVSQLTWARHGESGSMAVFHQTHGPSYSESKRLEFVAARQGAELRNASLRMSGLRVEDEGNYTCLFVTFPQGSRSVDIWL

SEQ ID NO: 604 - protein, 116 aa, Artificial Sequence
  CD155 v87 IgV
PGTGDVVVQAPTQVPGFLGDSVTLPCYLQVPNMEVTHVSQLQWARHGEKGSMAVFHQTFGPSYSESKRLEFVAARLGAELRNASLRMFGLRVEDEGNYTCQFVTFPQRSRSVDIWL

SEQ ID NO: 605 - protein, 116 aa, Artificial Sequence
  CD155 v88 IgV
PGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCQFVTFPQRSRSVDIWL

SEQ ID NO: 606 - protein, 116 aa, Artificial Sequence
  CD155 v89 IgV
PGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCEFVTFPQRSRSVDIWL

SEQ ID NO: 607 - protein, 116 aa, Artificial Sequence
  CD155 v90 IgV
PGTGDVVVQAPTQVPGFLGDSVTLPCYLQVPNMEVTHVSQLTWARHGESGSMAAFHQMQGPWYAESKRLEFVAARLGAELRNASLRMFGLRVDDEGNYTCTFVTFPQGSRSVDIWL

SEQ ID NO: 608 - protein, 116 aa, Artificial Sequence
  CD155 v91 IgV
PGTGDVVVQAPTQVLGFLGDSVTLPCYLQVPNMEVTHVSQLTWARHGESGSMATFHQSQGPYYAESKRLEFVAARLGAELRNASLRMFGLRVEDEGNYTCTFVTFPQGSRSVDIWL

SEQ ID NO: 609 - protein, 116 aa, Artificial Sequence
  CD155 v92 IgV
PGTGDVVVQAPTQVTGFLGDSVTLPCYLQVPNMEVTHVSQLQWARHGESGSMAVFHQTQGPSYSESKRLEFVAARLGAELRNASLRMFGLRVEDEGNYTCLFVTFPQGSRSVDIWL

SEQ ID NO: 610 - protein, 116 aa, Artificial Sequence
  CD155 v93 IgV
PGTGDVVVQAPTQVLGFLGDSVTLPCYLQVPNMEVTHVSQLTWARHGESGSMAAFHQMQGPWYAESKRLEFVAARLGAELRNASLRMFGLRVEDEGNYTCTFVTFPQGSRSVDIWL

SEQ ID NO: 611 - protein, 116 aa, Artificial Sequence
  CD155 v94 IgV
PGTGDVVVQAPTQVPGFLGDSVTLPCYLQVPNMEVTHVSQLTWARHGESGSMAVFHQMQGPWYAESKRLEFVAARLGAELRNASLRMFGLRVEDEGNYTCTFVTFPQGSRSVDIWL

SEQ ID NO: 612 - protein, 116 aa, Artificial Sequence
  CD155 v95 IgV
PGTGDVVVQAPTQVSGFLGDSVTLPCYLQVPNMEVTHAGQLGWARHGESGSMAVFHQTQGPSYSESKRLEFVAARLGAELRNASLRMFGLRVEDEGNYTCNFVTFPQGSRSVDIWL

SEQ ID NO: 613 - protein, 116 aa, Artificial Sequence
  CD155 v96 IgV
PGTGDVVVQAPTQVHGFLGDSVTLPCYLQVPNMEVTHVGQLIWARHGETRHMALFEQSQGPDYSGSKRLEFVAARLGAELRNASLRMFGLRVEDEGNYTCNFVTFPQGSRSVDIWL

SEQ ID NO: 614 - protein, 116 aa, Artificial Sequence
  CD155 v97 IgV
PGTGDVVVQAPTQVSGFLGDSVTLPCYLQVPNMEVTHVGQLVWARHGESGSMAVLHQTQGPSYWESKRLEFVAARLGAELRNASLRMFGLRVEDEGNYTCNFVTFPQGSRSVDIWL

SEQ ID NO: 615 - protein, 116 aa, Artificial Sequence
  CD155 v98 IgV
PGTGDVVVQAPTQVSGFLGDSVTLPCYLQVPNMEVTHVSQLIWARHGESGSMAVFHQTQGPSYSESKRLEFVAARLGAELRNASLRMFGLRVEDEGNYTCNFVTFPQGSRSVDIWL

SEQ ID NO: 616 - protein, 116 aa, Artificial Sequence
  CD155 v99 IgV
PGTGDVVVQAPTQVSGFLGDSVTLPCYLQVPNMEVTHVGQLGWARHGESGSMAVFHQTQGPSYSESKRLEFVAARLGAELRNASLRMFGLRVEDEGNYTCNFATFPQGSRSVDIWL

SEQ ID NO: 617 - protein, 116 aa, Artificial Sequence
  CD155 v100 IgV
PGTGDVVVQAPTQVHGFLGDSVTLPCYLQVPNMEVTRVGQLIWARHGETRHMALFEQSQGPDYSGSKRLEFVAARLGAELRNASLRMFGLRVEDEGNYTCYFLTHPQGSRSVDIWL

SEQ ID NO: 618 - protein, 116 aa, Artificial Sequence
  CD155 v101 IgV
PGTGDVVVQAPTQVPGFLGDSVTLPCYLQVPNMVVTHVGQLGWARHGESGSMAVFHQTQGPSYSESKRLEFVAARLGAELRNASLRMFGLRVEDEGNYTCNFVTFPQGSRSVDIWL

SEQ ID NO: 619 - protein, 116 aa, Artificial Sequence
  CD155 v102 IgV
PGTGDVVVQAPTQVSGFLGDSVTLPCYLQVPNMEVTHVSQLQWARHGESGSMAVFHQTQGPSYSESKRLEFVAARPGAELRNASLRMFGLRVEDEGNYTCTFVTFPQGSRSVDIWL

SEQ ID NO: 620 - protein, 116 aa, Artificial Sequence
  CD155 v103 IgV
PGTGDVVVQAPTQVLGFLGDSVTLPCYLQVPNMEVTHVSQLTWARHGESGSMAVFHQTRGPSYSESKRLEFVAARLGAELRNASLRMFGLRVEDEGNYTCLFVTFPQGSRSVDIWL

SEQ ID NO: 621 - protein, 116 aa, Artificial Sequence
  CD155 v104 IgV
PGTGDVVVQRPTQVPGFLGYSVTLPCYLQVPNMPVTHVLQLTWARHGEGGSMAVFHQTYGPSYSESKRLEFVAARLGEELRNASLRMFGLRVEDEGNYTCLFVTFPQGSRSVDIWL

SEQ ID NO: 622 - protein, 116 aa, Artificial Sequence
  CD155 v105 IgV
PGTGDVVVQAPTQVLGFLGDSVTLPCYLQVPNMEVTHVSQLTWARRGESGSMAVFHQTQGPSYSESKRLEFVAARLGAELRNASLRMFGLRVEDEGNYTCTFVTFPQGSRSVNIWL

SEQ ID NO: 623 - protein, 116 aa, Artificial Sequence
  CD155 v106 IgV
PGTGDVVVQRPTQVPGFLGYSVTLPCYLQVPNMPVTHVSQLTWARHGESGSMAVFHQTMGPSYSESKRLEFVAARLSPELRNASLRMFGLRVEDEGNYTCTFVTFPQGSRSVDIWL

SEQ ID NO: 624 - protein, 116 aa, Artificial Sequence
  CD155 v107 IgV
PGTGDVVVQAPTQVPGFLGDSVTLPCYLQVPNMEVTHVSQLTWARHGESGSMAVFHQTQGPTYSESKRLEFVAARLGAELRNASLRMFGLRVEDEGNYTCTFVTFPQGSRSVDIWL

SEQ ID NO: 625 - protein, 116 aa, Artificial Sequence
  CD155 v108 IgV
PGTGDVVVQRPTQVPGFLGYSVTLPCYLQVPNMPVTHVSQLTWARHGEGGSMAAFHQTMGPSYSESERLEFVAARLGAELRNASLRMFGLRVEDEGNYTCTFVTFPQGSRSVDIWL

SEQ ID NO: 626 - protein, 116 aa, Artificial Sequence
  CD155 v109 IgV
PGTGDVVVQAPTQVLGFLGDSVTLPCYLQVPNMEVTHVSQLTWVRHGESGSMAVFHQTYGPSYSESKRLDFVAARLGAELRNASLRMFGLRVEDEGNYTCTFVTFPQGSRSVDIWL

SEQ ID NO: 627 - protein, 116 aa, Artificial Sequence
  CD155 v110 IgV
PGTGDVVVQAPTQVPGFLGDSVTLPCYLQVPNMEVTTMSQLTWVRHGEQGSMAVFHQTLGPTYSESKRLRFVAARLGAELRNASLRMFGLRVEGSGNYTCTFVTFPQGSRSVNIWL

SEQ ID NO: 628 - protein, 116 aa, Artificial Sequence
  CD155 v111 IgV
PGTGDVVVQAPTQVLGFLGDSVTLPCYLQVPNMEVTHVPQLQWARHGESGSMAVFHQGQGPHYEESKRLEFVAARLGAELRNASLRMFGLRVEDEGNYTCTFVTFPQGSRSVNIWL

SEQ ID NO: 629 - protein, 116 aa, Artificial Sequence
  CD155 v112 IgV
PGTGDVVVQAPTQVSGFLGDSVTLPCYLQVPNMEVTTMSQLTWVRHGEQGSMAVFHQTLGPTYSESKRLRFVAARLGAELRNASLRMFGLRVEDEGNYTCMFATFPQGSRSVDIWL

SEQ ID NO: 630 - protein, 116 aa, Artificial Sequence
  CD155 v113 IgV
PGTGDVVVQAPTQVPGFLGDSVTLPCYLQVPNMEVTTMSQLTWVRHGEQGSMAVFHQTLGPTYSGSKRLRFVAARLGAELRNASLRMFGLRVEGSGNYTCTFVTFPQGSRSVDIWL

SEQ ID NO: 631 - protein, 116 aa, Artificial Sequence
  CD155 v114 IgV
PGTGDVVVQAPTQVPGFLGDSVTLPCYLQVPNMEVTHVSQLQWARHGEEGSMAVFHQTQGPSYSESKRLEFVAARLGAELRNASLRMFGLRVEDEGNYTCEFVTFPQGSRSVDIWL

SEQ ID NO: 632 - protein, 116 aa, Artificial Sequence
  CD155 v115 IgV
PGTGDVVVQAPTQVPGFLGDSVTLPCYLQVPNMEVTHVSQLQWARHGEEGSMAVFHQTFGPSYSESKRLEFVAARLGAELRNASLRMFGLRVEDEGNYTCEFVTFPQGSRSVDIWL

SEQ ID NO: 633 - protein, 116 aa, Artificial Sequence
  CD155 v116 IgV
PGTGDVVVQAPTQVFGFLGDSVMLPCYLQVPNMEVTHVSQVTWARHGESGSMAVFHQTKGPSYSESKRLEFVAARPGAELRNASLRMSGLRVEDEGNYTCMFVTFPQDSRSVDIWL

SEQ ID NO: 634 - protein, 116 aa, Artificial Sequence
  CD155 v117 IgV
PGTGDVVVQAPTQVSGFLGDSVTLPCYLQVPNMEVTHVSQLSWARHGESGSMAVFHQKQGPWYAESKRLEFVAARLGAELRNASLRMSGLRVEDEGNYTCLFVTFPQRSRSVDIWL

SEQ ID NO: 635 - protein, 116 aa, Artificial Sequence
  CD155 v118 IgV
PGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVMFPQGSRSVDIWL

SEQ ID NO: 636 - protein, 116 aa, Artificial Sequence
  CD155 v119 IgV
PGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWL

SEQ ID NO: 637 - protein, 122 aa, Artificial Sequence
  CD155 v23 IgV
WPPPGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCLFVTFPQGSRSVDIWLRVL

SEQ ID NO: 638 - protein, 122 aa, Artificial Sequence
  CD155 v24 IgV
WPPPGTGDVVVQAPTQVPGFLGDSVTLPCYLQVPNMEVTHVSQLQWARHGELGSMAVFHQTQGPSYSESKRLEFVAARLGAELRNASLRMFGLRVEDEGNYTCEFVTFPQRSRSVDIWLRVL

SEQ ID NO: 639 - protein, 122 aa, Artificial Sequence
  CD155 v25 IgV
WPPPGTGDVVVQAPTQVPGFLGDSVTLPCYLQVPNMEVTHVGQLTWARHGESGSMAVFHQTQGPSYSESKRLEFVAARLGAELRNASLRMFGLRVEDEGNYTCLFVTFPQGSRSVDIWLRVL

SEQ ID NO: 640 - protein, 122 aa, Artificial Sequence
  CD155 v26 IgV
WPPPGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCLFVTFPQGSRSVDIWLRVL

SEQ ID NO: 641 - protein, 122 aa, Artificial Sequence
  CD155 v27 IgV
WPPPGTGDVVVQAPTQVPGFLGDSVTLPCYLQVPNMEVTHVSQLTWARHGEQGSMAVFHQTQGPSYSESKRLEFVAARLGAELRNASLRMFGLRVEDEGNYTCLFVTFPQGSRSVDIWLRVL

SEQ ID NO: 642 - protein, 122 aa, Artificial Sequence
  CD155 v28 IgV
WPPPGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCQFVTFPQRSRSVDIWLRVL

SEQ ID NO: 643 - protein, 122 aa, Artificial Sequence
  CD155 v29 IgV
WPPPGTGDVVVQAPTQVPGFLGDSVTLPCYLQVPNMEVTHVAQLTWARHGEQGSMAVFHQTQGPSYSESKRLEFVAARLGAELRNASLRMFGLRVEDEGNYTCQFVTFPQRSRSVDIWLRVL

SEQ ID NO: 644 - protein, 122 aa, Artificial Sequence
  CD155 v30 IgV
WPPPGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCEFVTFPQGSRSVDIWLRVL

SEQ ID NO: 645 - protein, 122 aa, Artificial Sequence
  CD155 v31 IgV
WPPPGTGDVVVQAPTQVPGFLGDSVTLPCYLQVPNMEVTHVCQLTWARHGESGSMAVFHQTQGPSYSESKRLEFVAARLGAELRNASLRMFGLRVEDEGNYTCLFVTFPQGSRSVDIWLRVL

SEQ ID NO: 646 - protein, 122 aa, Artificial Sequence
  CD155 v32 IgV
WPPPGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCLFVTFPQGSRSVDIWLRVL

SEQ ID NO: 647 - protein, 122 aa, Artificial Sequence
  CD155 v33 IgV
WPPPGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCQFVTFPQGSRSVDIWLRVL

SEQ ID NO: 648 - protein, 122 aa, Artificial Sequence
  CD155 v34 IgV
WPPPGTGDVVVQAPTQVPGFLGDSVTLPCYLQVPNMEVTHVLQLTWARHGELGSMAVFHQTFGPSYSESKRLEFVAARLGAELRNASLRMFGLRVEDEGNYTCQFVTFPQGSRSVDIWLRVL

SEQ ID NO: 649 - protein, 122 aa, Artificial Sequence
  CD155 v35 IgV
WPPPGTGDVVVQAPTQVPGFLGDSVTLPCYLQVPNMEVTHVWQLTWARHGESGSMAVFHQTQGPSYSESKRLEFVAARLGAELRNASLRMFGLRVEDEGNYTCLFVTFPQGSRSVDIWLRVL

SEQ ID NO: 650 - protein, 122 aa, Artificial Sequence
  CD155 v36 IgV
WPPPGTGDVVVQAPTQVPGFLGDSVTLPCYLQVPNMEVTHVQQLTWARHGESGSMAVFHQTQGPSYSESKRLEFVAARLGAELRNASLRMFGLRVEDEGNYTCLFVTFPQGSRSVDIWLRVL

SEQ ID NO: 651 - protein, 122 aa, Artificial Sequence
  CD155 v37 IgV
WPPPGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCLFVTFPQGSRSVDIWLRVL

SEQ ID NO: 652 - protein, 122 aa, Artificial Sequence
  CD155 v38 IgV
WPPPGTGDVVVQAPTQVPGFLGDSVTLPCYLQVPNMEVTHVSQLTWARHGERGSMAVFHQTQGPSYSESKRLEFVAARLGAELRNASLRMFGLRVEDEGNYTCLFVTFPQGSRSVDIWLRVL

SEQ ID NO: 653 - protein, 122 aa, Artificial Sequence
  CD155 v39 IgV
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCEFVTFPQGSRSVDIWLRVL

SEQ ID NO: 654 - protein, 122 aa, Artificial Sequence
  CD155 v40 IgV
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQRSRSVDIWLRVL

SEQ ID NO: 655 - protein, 122 aa, Artificial Sequence
  CD155 v41 IgV
WPPPGTGDVVVQAPTQVPGFLGDSVTLPCYLQVPNMEVTHVSQLTWARHGEEGSMAVFHQTQGPSYSESKRLEFVAARLGAELRNASLRMFGLRVEDEGNYTCLFVTFPQGSRSVDIWLRVL

SEQ ID NO: 656 - protein, 122 aa, Artificial Sequence
  CD155 v42 IgV
WPPPGTGDVVVQAPTQVPGFLGDSVTLPCYLQVPNMEVTHVSQLTWARHGESGSMAVFHQTYGPSYSESKRLEFVAARLGAELRNASLRMFGLRVEDEGNYTCLFVTFPQGSRSVDIWLRVL

SEQ ID NO: 657 - protein, 122 aa, Artificial Sequence
  CD155 v43 IgV
WPPPGTGDVVVQAPTQVPGFLGDSVTLPCYLQVPNMEVTHVSQLQWARHGEMGSMAVFHQTQGPSYSESKRLEFVAARLGAELRNASLRMFGLRVEDEGNYTCEFVTFPQGSRSVDIWLRVL

SEQ ID NO: 658 - protein, 122 aa, Artificial Sequence
  CD155 v44 IgV
WPPPGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCQFVTFPQRSRSVDIWLRVL

SEQ ID NO: 659 - protein, 122 aa, Artificial Sequence
  CD155 v45 IgV
WPPPGTGDVVVQAPTQVPGFLGDSVTLPCYLQVPNMEVTHVSQLTWARHGEMGSMALFHQTQGPSYSESKRLEFVAARLGAELRNASLRMFGLRVEDEGNYTCLFVTFPQGSRSVDIWLRVL

SEQ ID NO: 660 - protein, 122 aa, Artificial Sequence
  CD155 v46 IgV
WPPPGTGDVVVQAPTQVPGFLGDSVTLPCYLQVPNMEVTHVNQLTWARHGEQGSMAVFHQTFGPSYSESKRLEFVAARLGAELRNASLRMFGLRVEDEGNYTCLFVTFPQGSRSVDIWLRVL

SEQ ID NO: 661 - protein, 122 aa, Artificial Sequence
  CD155 v47 IgV
WPPPGTGDVVVQAPTQVPGFLGDSVTLPCYLQVPNMEVTHVAQLTWARHGELGSMAVFHQTQGPSYSESKRLEFVAARLGAELRNASLRMFGLRVEDEGNYTCEFVTFPQRSRSVDIWLRVL

SEQ ID NO: 662 - protein, 122 aa, Artificial Sequence
  CD155 v48 IgV
WPPPGTGDVVVQAPTQVPGFLGDSVTLPCYLQVPNMEVTHVWQLTWARHGEQGSMALFHQTYGPSYSESKRLEFVAARLGAELRNASLRMFGLRVEDEGNYTCLFVTFPQGSRSVDIWLRVL

SEQ ID NO: 663 - protein, 122 aa, Artificial Sequence
  CD155 v49 IgV
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCQFVTFPQGSRSVDIWLRVL

SEQ ID NO: 664 - protein, 122 aa, Artificial Sequence
  CD155 v50 IgV
WPPPGTGDVVVQAPTQVPGFLGDSVTLPCYLQVPNMEVTHVLQLTWARHGEQGSMAVFHQTQGPSYSESKRLEFVAARLGAELRNASLRMFGLRVEDEGNYTCEFVTFPQGSRSVDIWLRVL

SEQ ID NO: 665 - protein, 122 aa, Artificial Sequence
  CD155 v51 IgV
WPPPGTGDVVVQAPTQVPGFLGDSVTLPCYLQVPNMEVTHVCQLTWARHGELGSMAVFHQTQGPSYSESKRLEFVAARLGAELRNASLRMFGLRVEDEGNYTCLFVTFPQGSRSVDIWLRVL

SEQ ID NO: 666 - protein, 122 aa, Artificial Sequence
  CD155 v52 IgV
WPPPGTGDVVVQAPTQVPGFLGDSVTLPCYLQVPNMEVTHVWQLTWARHGERGSMAVFHQTYGPSYSESKRLEFVAARLGAELRNASLRMFGLRVEDEGNYTCQFVTFPQGSRSVDIWLRVL

SEQ ID NO: 667 - protein, 122 aa, Artificial Sequence
  CD155 v53 IgV
WPPPGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCEFVTFPQGSRSVDIWLRVL

SEQ ID NO: 668 - protein, 122 aa, Artificial Sequence
  CD155 v54 IgV
WPPPGTGDVVVQAPTQVPGFLGDSVTLPCYLQVPNMEVTHVSQLTWARHGERGSMAVFHQTFGPSYSESKRLEFVAARLGAELRNASLRMFGLRVEDEGNYTCQFVTFPQRSRSVDIWLRVL

SEQ ID NO: 669 - protein, 122 aa, Artificial Sequence
  CD155 v55 IgV
WPPPGTGDVVVQAPTQVPGFLGDSVTLPCYLQVPNMEVTHVSQLQWARHGELGSMALFHQTQGPSYSESKRLEFVAARLGAELRNASLRMFGLRVEDEGNYTCEFVTFPQGSRSVDIWLRVL

SEQ ID NO: 670 - protein, 122 aa, Artificial Sequence
  CD155 v56 IgV
WPPPGTGDVVVQAPTQVPGFLGDSVTLPCYLQVPNMEVTHVSQLTWARHGEMGSMAVFHQTYGPSYSESKRLEFVAARLGAELRNASLRMFGLRVEDEGNYTCLFVTFPQGSRSVDIWLRVL

SEQ ID NO: 671 - protein, 122 aa, Artificial Sequence
  CD155 v57 IgV
WPPPGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCEFVTFPQRSRSVDIWLRVL

SEQ ID NO: 672 - protein, 122 aa, Artificial Sequence
  CD155 v58 IgV
WPPPGTGDVVVQAPTQVPGFLGDSVTLPCYLQVPNMEVTHVSQLQWARHGEQGSMAVFHQTQGPSYSESKRLEFVAARLGAELRNASLRMFGLRVEDEGNYTCLFVTFPQGSRSVDIWLRVL

SEQ ID NO: 673 - protein, 122 aa, Artificial Sequence
  CD155 v59 IgV
WPPPGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCEFVTFPQGSRSVDIWLRVL

SEQ ID NO: 674 - protein, 122 aa, Artificial Sequence
  CD155 v60 IgV
WPPPGTGDVVVQAPTQVPGFLGDSVTLPCYLQVPNMEVTHVVQLTWARHGEEGSMAVFHQTQGPSYSESKRLEFVAARLGAELRNASLRMFGLRVEDEGNYTCLFVTFPQGSRSVDIWLRVL

SEQ ID NO: 675 - protein, 122 aa, Artificial Sequence
  CD155 v61 IgV
WPPPGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCLFVTFPQRSRSVDIWLRVL

SEQ ID NO: 676 - protein, 122 aa, Artificial Sequence
  CD155 v62 IgV
WPPPGTGDVVVQAPTQVPGFLGDSVTLPCYLQVPNMEVTHVGQLTWARHGEQGSMAVFHQTQGPSYSESKRLEFVAARLGAELRNASLRMFGLRVEDEGNYTCEFVTFPQRSRSVDIWLRVL

SEQ ID NO: 677 - protein, 122 aa, Artificial Sequence
  CD155 v63 IgV
WPPPGTGDVVVQAPTQVPGFLGDSVTLPCYLQVPNMEVTHVNQLTWARHGEEGSMALFHQTQGPSYSESKRLEFVAARLGAELRNASLRMFGLRVEDEGNYTCEFVTFPQGSRSVDIWLRVL

SEQ ID NO: 678 - protein, 122 aa, Artificial Sequence
  CD155 v64 IgV
WPPPGTGDVVVQAPTQVPGFLGDSVTLPCYLQVPNMEVTHVCQLTWARHGEMGSMAVFHQTFGPSYSESKRLEFVAARLGAELRNASLRMFGLRVEDEGNYTCLFVTFPQGSRSVDIWLRVL

SEQ ID NO: 679 - protein, 122 aa, Artificial Sequence
  CD155 v65 IgV
WPPPGTGDVVVQAPTQVPGFLGDSVTLPCYLQVPNMEVTHVLQLTWARHGESGSMAVFHQTQGPSYSESKRLEFVAARLGAELRNASLRMFGLRVEDEGNYTCLFVTFPQGSRSVDIWLRVL

SEQ ID NO: 680 - protein, 122 aa, Artificial Sequence
  CD155 v66 IgV
WPPPGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCLFVTFPQGSRSVDIWLRVL

SEQ ID NO: 681 - protein, 122 aa, Artificial Sequence
  CD155 v67 IgV
WPPPGTGDVVVQAPTQVPGFLGDSVTLPCYLQVPNMEVTHVGQLTWARHGELGSMAVFHQTFGPSYSESKRLEFVAARLGAELRNASLRMFGLRVEDEGNYTCQFVTFPQGSRSVDIWLRVL

SEQ ID NO: 682 - protein, 122 aa, Artificial Sequence
  CD155 v68 IgV
WPPPGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCLFVTFPQGSRSVDIWLRVL

SEQ ID NO: 683 - protein, 122 aa, Artificial Sequence
  CD155 v69 IgV
WPPPGTGDVVVQAPTQVTGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWLRVL

SEQ ID NO: 684 - protein, 122 aa, Artificial Sequence
  CD155 v70 IgV
WPPPGTGDVVVQAPTQVFGFLGDSVTLPCYLQVPNMEVAHVSQLQWARHGESGSMAVFHQRQGPNYLESKRLGFVAAGLGAELRNASLRMFGLRVEDEGNYTCLFVTFPQGSRSVDIWLRVL

SEQ ID NO: 685 - protein, 122 aa, Artificial Sequence
  CD155 v71 IgV
WPPPGTGDVVVQAPTQVTGFLGDSVTLPCYLQVPNMEVTHVSQLQWARHGESGSMAVFHQRQGPNYLESKRLEFVAARLGAELRNASLRMFGLRVEDEGNYTCLFVTFPQGSRSVDIWLRVL

SEQ ID NO: 686 - protein, 122 aa, Artificial Sequence
  CD155 v72 IgV
WPPPGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWLRVL

SEQ ID NO: 687 - protein, 122 aa, Artificial Sequence
  CD155 v73 IgV
WPPPGTGDVVVQAPTQVFGFLGDSVTLPCYLQVPNMEVTHVSQLQWARHGESGSMAVFHQRQGPNYLESKRLEFVAARLGAELRNASLRMSGLRVEDEGNYTCPFVTFPQGSRSVDIWLRVL

SEQ ID NO: 688 - protein, 122 aa, Artificial Sequence
  CD155 v74 IgV
WPPPGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWLRVL

SEQ ID NO: 689 - protein, 122 aa, Artificial Sequence
  CD155 v75 IgV
WPPPGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCMFVTFPQGSRSVDIWLRVL

SEQ ID NO: 690 - protein, 122 aa, Artificial Sequence
  CD155 v76 IgV
WPPPGTGDVVVQAPTQVPGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWLRVL

SEQ ID NO: 691 - protein, 122 aa, Artificial Sequence
  CD155 v77 IgV
WPPPGTGDVVVQAPTQVTGFLGDSVTLPCYLQVPNMEVTHVSQLQWARHGESGSMAVFHQTQGPSYSESKRLEFVAARPGAELRNASLRMFGLRVEDEGNYTCLFVTFPQGSRSVDIWLRVL

SEQ ID NO: 692 - protein, 122 aa, Artificial Sequence
  CD155 v78 IgV
WPPPGTGDVVVQAPTQVTGFLGDSVTLPCYLQVPNMEVTHVSQLQWARHGESGSMAVFHQRQGPHYHESKRLEFVAARLGAELRNASLRMFGLRVEDEGNYTCLFVTFPQGSRSVDIWLRVL

SEQ ID NO: 693 - protein, 122 aa, Artificial Sequence
  CD155 v79 IgV
WPPPGTGDVVVQAPTQVTGFLGDSVTLPCYLQVPNMEVTHVSQLTWARHGESGSMAVFHQTQGPSYSESKRLEFVAARLGEELRNASLRMFGLRVEDEGNYTCLFVTFPQGSRSVDIWLRVL

SEQ ID NO: 694 - protein, 122 aa, Artificial Sequence
  CD155 v80 IgV
WPPPGTGDVVVQAPTQVSGFLGYSVTLPCYLQVPNMPVTHVSQLTWARHGEGGSMAVFHQTMGPSYSESKRLEFVAARLSPELRNASLRMFGLRVEDEYNYTCLFVTFPQGNRSVDIWLRVL

SEQ ID NO: 695 - protein, 122 aa, Artificial Sequence
  CD155 v81 IgV
WPPPGTGDVVVQRPTQVPGFLGYSVTLPCYLQVPNMPVTHVPQLTWARHGESGSMAVFHQTYGPSYSESKRLEFVAARLGEELRNASLRMFGLRVEDEGNYTCLFVTFPQGSRSVDIWLRVL

SEQ ID NO: 696 - protein, 122 aa, Artificial Sequence
  CD155 v82 IgV
WPPPGTGDVVVQRPTQVPGFLGYSVTLPCYLQVPNMPVTHVSQLTWARHGESGSMAVFHQTQGPSYSESKRLEFVAARLGAELRNASLRMFGLRVEDEYNYTCLFVTFPQGNRSVDIWLRVL

SEQ ID NO: 697 - protein, 122 aa, Artificial Sequence
  CD155 v83 IgV
WPPPGTGDVVVQRPTQVPGFLGYSVTLPCYLQVPNMPVTHVSQLTWARHGESGSMAVFHQTMGPSYSESKRLEFVAVRLSPELRNASLRMFGLRVEDEYNYTCLFVTFPQGSRSVDIWLRVL

SEQ ID NO: 698 - protein, 122 aa, Artificial Sequence
  CD155 v84 IgV
WPPPGTGDVVVQAPTQVLGFLGDSVTLPCYLQVPNMSVTHVSQLTWARHGESGSMAVFHQTMGPSYSESKRLEFVAARLSPELRNASLRMFGLRVEDEYNYTCLFVTFPQGNRSVDIWLRVL

SEQ ID NO: 699 - protein, 122 aa, Artificial Sequence
  CD155 v85 IgV
WPPPGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCTFVTFPQGSRSVDIWLRVL

SEQ ID NO: 700 - protein, 122 aa, Artificial Sequence
  CD155 v86 IgV
WPPPGTGDVVVQAPTQVSGFLGDSVTLPCYLQVPNMEVTHVSQLTWARHGESGSMAVFHQTHGPSYSESKRLEFVAARQGAELRNASLRMSGLRVEDEGNYTCLFVTFPQGSRSVDIWLRVL

SEQ ID NO: 701 - protein, 122 aa, Artificial Sequence
  CD155 v87 IgV
WPPPGTGDVVVQAPTQVPGFLGDSVTLPCYLQVPNMEVTHVSQLQWARHGEKGSMAVFHQTFGPSYSESKRLEFVAARLGAELRNASLRMFGLRVEDEGNYTCQFVTFPQRSRSVDIWLRVL

SEQ ID NO: 702 - protein, 122 aa, Artificial Sequence
  CD155 v88 IgV
WPPPGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCQFVTFPQRSRSVDIWLRVL

SEQ ID NO: 703 - protein, 122 aa, Artificial Sequence
  CD155 v89 IgV
WPPPGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCEFVTFPQRSRSVDIWLRVL

SEQ ID NO: 704 - protein, 122 aa, Artificial Sequence
  CD155 v90 IgV
WPPPGTGDVVVQAPTQVPGFLGDSVTLPCYLQVPNMEVTHVSQLTWARHGESGSMAAFHQMQGPWYAESKRLEFVAARLGAELRNASLRMFGLRVDDEGNYTCTFVTFPQGSRSVDIWLRVL

SEQ ID NO: 705 - protein, 122 aa, Artificial Sequence
  CD155 v91 IgV
WPPPGTGDVVVQAPTQVLGFLGDSVTLPCYLQVPNMEVTHVSQLTWARHGESGSMATFHQSQGPYYAESKRLEFVAARLGAELRNASLRMFGLRVEDEGNYTCTFVTFPQGSRSVDIWLRVL

SEQ ID NO: 706 - protein, 122 aa, Artificial Sequence
  CD155 v92 IgV
WPPPGTGDVVVQAPTQVTGFLGDSVTLPCYLQVPNMEVTHVSQLQWARHGESGSMAVFHQTQGPSYSESKRLEFVAARLGAELRNASLRMFGLRVEDEGNYTCLFVTFPQGSRSVDIWLRVL

SEQ ID NO: 707 - protein, 122 aa, Artificial Sequence
  CD155 v93 IgV
WPPPGTGDVVVQAPTQVLGFLGDSVTLPCYLQVPNMEVTHVSQLTWARHGESGSMAAFHQMQGPWYAESKRLEFVAARLGAELRNASLRMFGLRVEDEGNYTCTFVTFPQGSRSVDIWLRVL

SEQ ID NO: 708 - protein, 122 aa, Artificial Sequence
  CD155 v94 IgV
WPPPGTGDVVVQAPTQVPGFLGDSVTLPCYLQVPNMEVTHVSQLTWARHGESGSMAVFHQMQGPWYAESKRLEFVAARLGAELRNASLRMFGLRVEDEGNYTCTFVTFPQGSRSVDIWLRVL

SEQ ID NO: 709 - protein, 122 aa, Artificial Sequence
  CD155 v95 IgV
WPPPGTGDVVVQAPTQVSGFLGDSVTLPCYLQVPNMEVTHAGQLGWARHGESGSMAVFHQTQGPSYSESKRLEFVAARLGAELRNASLRMFGLRVEDEGNYTCNFVTFPQGSRSVDIWLRVL

SEQ ID NO: 710 - protein, 122 aa, Artificial Sequence
  CD155 v96 IgV
WPPPGTGDVVVQAPTQVHGFLGDSVTLPCYLQVPNMEVTHVGQLIWARHGETRHMALFEQSQGPDYSGSKRLEFVAARLGAELRNASLRMFGLRVEDEGNYTCNFVTFPQGSRSVDIWLRVL

SEQ ID NO: 711 - protein, 122 aa, Artificial Sequence
  CD155 v97 IgV
WPPPGTGDVVVQAPTQVSGFLGDSVTLPCYLQVPNMEVTHVGQLVWARHGESGSMAVLHQTQGPSYWESKRLEFVAARLGAELRNASLRMFGLRVEDEGNYTCNFVTFPQGSRSVDIWLRVL

SEQ ID NO: 712 - protein, 122 aa, Artificial Sequence
  CD155 v98 IgV
WPPPGTGDVVVQAPTQVSGFLGDSVTLPCYLQVPNMEVTHVSQLIWARHGESGSMAVFHQTQGPSYSESKRLEFVAARLGAELRNASLRMFGLRVEDEGNYTCNFVTFPQGSRSVDIWLRVL

SEQ ID NO: 713 - protein, 122 aa, Artificial Sequence
  CD155 v99 IgV
WPPPGTGDVVVQAPTQVSGFLGDSVTLPCYLQVPNMEVTHVGQLGWARHGESGSMAVFHQTQGPSYSESKRLEFVAARLGAELRNASLRMFGLRVEDEGNYTCNFATFPQGSRSVDIWLRVL

SEQ ID NO: 714 - protein, 122 aa, Artificial Sequence
  CD155 v100 IgV
WPPPGTGDVVVQAPTQVHGFLGDSVTLPCYLQVPNMEVTRVGQLIWARHGETRHMALFEQSQGPDYSGSKRLEFVAARLGAELRNASLRMFGLRVEDEGNYTCYFLTHPQGSRSVDIWLRVL

SEQ ID NO: 715 - protein, 122 aa, Artificial Sequence
  CD155 v101 IgV
WPPPGTGDVVVQAPTQVPGFLGDSVTLPCYLQVPNMVVTHVGQLGWARHGESGSMAVFHQTQGPSYSESKRLEFVAARLGAELRNASLRMFGLRVEDEGNYTCNFVTFPQGSRSVDIWLRVL

SEQ ID NO: 716 - protein, 122 aa, Artificial Sequence
  CD155 v102 IgV
WPPPGTGDVVVQAPTQVSGFLGDSVTLPCYLQVPNMEVTHVSQLQWARHGESGSMAVFHQTQGPSYSESKRLEFVAARPGAELRNASLRMFGLRVEDEGNYTCTFVTFPQGSRSVDIWLRVL

SEQ ID NO: 717 - protein, 122 aa, Artificial Sequence
  CD155 v103 IgV
WPPPGTGDVVVQAPTQVLGFLGDSVTLPCYLQVPNMEVTHVSQLTWARHGESGSMAVFHQTRGPSYSESKRLEFVAARLGAELRNASLRMFGLRVEDEGNYTCLFVTFPQGSRSVDIWLRVL

SEQ ID NO: 718 - protein, 122 aa, Artificial Sequence
  CD155 v104 IgV
WPPPGTGDVVVQRPTQVPGFLGYSVTLPCYLQVPNMPVTHVLQLTWARHGEGGSMAVFHQTYGPSYSESKRLEFVAARLGEELRNASLRMFGLRVEDEGNYTCLFVTFPQGSRSVDIWLRVL

SEQ ID NO: 719 - protein, 122 aa, Artificial Sequence
  CD155 v105 IgV
WPPPGTGDVVVQAPTQVLGFLGDSVTLPCYLQVPNMEVTHVSQLTWARRGESGSMAVFHQTQGPSYSESKRLEFVAARLGAELRNASLRMFGLRVEDEGNYTCTFVTFPQGSRSVNIWLRVL

SEQ ID NO: 720 - protein, 122 aa, Artificial Sequence
  CD155 v106 IgV
WPPPGTGDVVVQRPTQVPGFLGYSVTLPCYLQVPNMPVTHVSQLTWARHGESGSMAVFHQTMGPSYSESKRLEFVAARLSPELRNASLRMFGLRVEDEGNYTCTFVTFPQGSRSVDIWLRVL

SEQ ID NO: 721 - protein, 122 aa, Artificial Sequence
  CD155 v107 IgV
WPPPGTGDVVVQAPTQVPGFLGDSVTLPCYLQVPNMEVTHVSQLTWARHGESGSMAVFHQTQGPTYSESKRLEFVAARLGAELRNASLRMFGLRVEDEGNYTCTFVTFPQGSRSVDIWLRVL

SEQ ID NO: 722 - protein, 122 aa, Artificial Sequence
  CD155 v108 IgV
WPPPGTGDVVVQRPTQVPGFLGYSVTLPCYLQVPNMPVTHVSQLTWARHGEGGSMAAFHQTMGPSYSESERLEFVAARLGAELRNASLRMFGLRVEDEGNYTCTFVTFPQGSRSVDIWLRVL

SEQ ID NO: 723 - protein, 122 aa, Artificial Sequence
  CD155 v109 IgV
WPPPGTGDVVVQAPTQVLGFLGDSVTLPCYLQVPNMEVTHVSQLTWVRHGESGSMAVFHQTYGPSYSESKRLDFVAARLGAELRNASLRMFGLRVEDEGNYTCTFVTFPQGSRSVDIWLRVL

SEQ ID NO: 724 - protein, 122 aa, Artificial Sequence
  CD155 v110 IgV
WPPPGTGDVVVQAPTQVPGFLGDSVTLPCYLQVPNMEVTTMSQLTWVRHGEQGSMAVFHQTLGPTYSESKRLRFVAARLGAELRNASLRMFGLRVEGSGNYTCTFVTFPQGSRSVNIWLRVL

SEQ ID NO: 725 - protein, 122 aa, Artificial Sequence
  CD155 v111 IgV
WPPPGTGDVVVQAPTQVLGFLGDSVTLPCYLQVPNMEVTHVPQLQWARHGESGSMAVFHQGQGPHYEESKRLEFVAARLGAELRNASLRMFGLRVEDEGNYTCTFVTFPQGSRSVNIWLRVL

SEQ ID NO: 726 - protein, 122 aa, Artificial Sequence
  CD155 v112 IgV
WPPPGTGDVVVQAPTQVSGFLGDSVTLPCYLQVPNMEVTTMSQLTWVRHGEQGSMAVFHQTLGPTYSESKRLRFVAARLGAELRNASLRMFGLRVEDEGNYTCMFATFPQGSRSVDIWLRVL

SEQ ID NO: 727 - protein, 122 aa, Artificial Sequence
  CD155 v113 IgV
WPPPGTGDVVVQAPTQVPGFLGDSVTLPCYLQVPNMEVTTMSQLTWVRHGEQGSMAVFHQTLGPTYSGSKRLRFVAARLGAELRNASLRMFGLRVEGSGNYTCTFVTFPQGSRSVDIWLRVL

SEQ ID NO: 728 - protein, 122 aa, Artificial Sequence
  CD155 v114 IgV
WPPPGTGDVVVQAPTQVPGFLGDSVTLPCYLQVPNMEVTHVSQLQWARHGEEGSMAVFHQTQGPSYSESKRLEFVAARLGAELRNASLRMFGLRVEDEGNYTCEFVTFPQGSRSVDIWLRVL

SEQ ID NO: 729 - protein, 122 aa, Artificial Sequence
  CD155 v115 IgV
WPPPGTGDVVVQAPTQVPGFLGDSVTLPCYLQVPNMEVTHVSQLQWARHGEEGSMAVFHQTFGPSYSESKRLEFVAARLGAELRNASLRMFGLRVEDEGNYTCEFVTFPQGSRSVDIWLRVL

SEQ ID NO: 730 - protein, 122 aa, Artificial Sequence
  CD155 v116 IgV
WPPPGTGDVVVQAPTQVFGFLGDSVMLPCYLQVPNMEVTHVSQVTWARHGESGSMAVFHQTKGPSYSESKRLEFVAARPGAELRNASLRMSGLRVEDEGNYTCMFVTFPQDSRSVDIWLRVL

SEQ ID NO: 731 - protein, 122 aa, Artificial Sequence
  CD155 v117 IgV
WPPPGTGDVVVQAPTQVSGFLGDSVTLPCYLQVPNMEVTHVSQLSWARHGESGSMAVFHQKQGPWYAESKRLEFVAARLGAELRNASLRMSGLRVEDEGNYTCLFVTFPQRSRSVDIWLRVL

SEQ ID NO: 732 - protein, 122 aa, Artificial Sequence
  CD155 v118 IgV
WPPPGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVMFPQGSRSVDIWLRVL

SEQ ID NO: 733 - protein, 122 aa, Artificial Sequence
  CD155 v119 IgV
WPPPGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWLRVL

SEQ ID NO: 734 - protein, 125 aa, Homo sapiens [sequence omitted]

SEQ ID NO: 735 - protein, 329 aa, Artificial Sequence
  CD112 v1 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKDSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 736 - protein, 329 aa, Artificial Sequence
  CD112 v2 ECD
QDVRVQVLPEVRGQLGGTAELPCHLLPPVPGLHISLVTWQRPDAPANHQNVAAFHPKMGPSFPGPKPGSERLSFVSAKQGTGQDTEAELQDATLALHSLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 737 - protein, 329 aa, Artificial Sequence
  CD112 v3 ECD
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 738 - protein, 329 aa, Artificial Sequence
  CD112 v4 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFITFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 739 - protein, 329 aa, Artificial Sequence
  CD112 v5 ECD
QDVRVQVLPEVRGQLGGTVELPCHLLPSVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 740 - protein, 329 aa, Artificial Sequence
  CD112 v6 ECD
QDVRVQVLPEVRGQLGGTVELPCHLLAPVPGLYISLVNWQRPDAPANHQNVAAFHPKMGPSFPSPKPGSERLSFVSAKQSTGQDTEAELQDATLALHGLTAEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 741 - protein, 329 aa, Artificial Sequence
  CD112 v7 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 742 - protein, 329 aa, Artificial Sequence
  CD112 v8 ECD
QDVRVQVLPEVWGQLGGTVELPCHLLPPVPGLYISLVTWQRPDAPANYQNVAASHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 743 - protein, 329 aa, Artificial Sequence
  CD112 v9 ECD
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 744 - protein, 329 aa, Artificial Sequence
  CD112 v10 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFASFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 745 - protein, 329 aa, Artificial Sequence
  CD112 v11 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 746 - protein, 329 aa, Artificial Sequence
  CD112 v12 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 747 - protein, 329 aa, Artificial Sequence
  CD112 v13 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 748 - protein, 329 aa, Artificial Sequence
  CD112 v14 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLTPHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 749 - protein, 329 aa, Artificial Sequence
  CD112 v15 ECD
QDVRVQVLPEVRGQLGGTVELPCHLLPPVPGLHISLVTWQRPDAPANHQNVAAFHPKMGPSFPSPKSGSERLSFVSAKQSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 750 - protein, 329 aa, Artificial Sequence
  CD112 v16 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 751 - protein, 329 aa, Artificial Sequence
  CD112 v17 ECD
QDVRVQVLPEVRGQLGGSVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 752 - protein, 329 aa, Artificial Sequence
  CD112 v18 ECD
QDVRVQVLSEVRGQLGGTVELPCHLLPPVPGLHISLVTWQRPDAPASHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 753 - protein, 329 aa, Artificial Sequence
  CD112 v19 ECD
QDVRVQVLPEVRGQLGGTVELPCHLLPPVPGLYISLVTWQRSDAPANHQNVAAFHPKMGPSFPSPKHGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 754 - protein, 329 aa, Artificial Sequence
  CD112 v20 ECD
QDVRVQVLPEVRGQLGGTVELPCHLLLPVPGPYISLVTWQRSDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 755 - protein, 329 aa, Artificial Sequence
  CD112 v21 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHDLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 756 - protein, 329 aa, Artificial Sequence
  CD112 v22 ECD
QDVRVQVLPEVRGQLGGTVELPCHLLPPVPGLHIPLVTWQRPDAPANHQNVAAFHPKMGPSFPSPKPGSERLSFVSAKQSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 757 - protein, 329 aa, Artificial Sequence
  CD112 v23 ECD
QDVRVQVLPEVRGQLGGTVELPCHLLPPVPGPYISLVTWQRSDAPANHQNVAAFHPKMGPSFPSPKPGSERLSFVSAKQSTGQDTEAELQDATLALHGLAVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 758 - protein, 329 aa, Artificial Sequence
  CD112 v24 ECD
QDVRVQVLPEVRGQLGGTVELPCHLLSPVPGLYISLVTWQRPDASANHQNVAAFHPKMGPSFPSPKPGSERLSFVSAKQSTGQDTEAELQDATLALHGLTVEDEGIYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 759 - protein, 329 aa, Artificial Sequence
  CD112 v25 ECD
QDVRVQVLPEVRGQLGGTVELPCHLLPPVPGLHISLVTWQRPDAPAKHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 760 - protein, 329 aa, Artificial Sequence
  CD112 v26 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 761 - protein, 329 aa, Artificial Sequence
  CD112 v27 ECD
QDVRVQVLPEVRGQLGGTVELPCHLLPPVPGLYISLVTWQRPDAPANHQNVAAFHPKMGPSFPSPKPGSERLSFVSARQSTGQGTEAELQDATLALHGLTVEDEGNYTCEFVTSPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 762 - protein, 329 aa, Artificial Sequence
  CD112 v28 ECD
QDVRVQVLPEVRGQLGGTVELPCHLLPPVPGLHISLVTWQRPDAPAKHQNVAALHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 763 - protein, 329 aa, Artificial Sequence
  CD112 v29 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 764 - protein, 329 aa, Artificial Sequence
  CD112 v30 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 765 - protein, 329 aa, Artificial Sequence
  CD112 v31 ECD
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 766 - protein, 329 aa, Artificial Sequence
  CD112 v32 ECD
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 767 - protein, 329 aa, Artificial Sequence
  CD112 v33 ECD
QDVRVQVLPEVRGQLGGTVELPCHLLPPVPGLHISLVTWQRPDAPANHQNMAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 768 - protein, 329 aa, Artificial Sequence
  CD112 v34 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 769 - protein, 329 aa, Artificial Sequence
  CD112 v35 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTAEDEGNYTCEFVTFSKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 770 - protein, 329 aa, Artificial Sequence
  CD112 v36 ECD
QDVRVQVLPEVRGQLGGTVELPCRLLPPVPGLYISLVNWQRPGAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 771 - protein, 329 aa, Artificial Sequence
  CD112 v37 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 772 - protein, 329 aa, Artificial Sequence
  CD112 v38 ECD
QDVRVQVLPEVRGQLGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 773 - protein, 329 aa, Artificial Sequence
  CD112 v39 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 774 - protein, 329 aa, Artificial Sequence
  CD112 v40 ECD
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGITWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 775 - protein, 329 aa, Artificial Sequence
  CD112 v41 ECD
QDVRVQVLPEVRGQLGGTVELPCHLLPPVPGLYISLVTWQRPDAPANHQNVAAFHPKMGPSFPSPKPGSERLSFVSAKQSTGKDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 776 - protein, 329 aa, Artificial Sequence
  CD112 v42 ECD
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 777 - protein, 329 aa, Artificial Sequence
  CD112 v43 ECD
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 778 - protein, 329 aa, Artificial Sequence
  CD112 v44 ECD
QDVRVQVLPEVRGQLGGTVELPCHLLSPVPGLYISLVTWQRPDAPANHQNVAAFHPKMGPSFPSPKPGSERLSFVSAKQSTGQDTEAELRDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 779 - protein, 329 aa, Artificial Sequence
  CD112 v45 ECD
QDVRVQVLPEVRGQVGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 780 - protein, 329 aa, Artificial Sequence
  CD112 v46 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYICEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 781 - protein, 329 aa, Artificial Sequence
  CD112 v47 ECD
QDVRVQVLPEVRGQLGGTVELPCHLLPPVPGLHISLVTWQRPDAPANHQNVAAFHLKMGPSFPSPKPGSERLSFMSAKQSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 782 - protein, 125 aa, Artificial Sequence
  CD112 v1 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKDSVRGMTWL

SEQ ID NO: 783 - protein, 125 aa, Artificial Sequence
  CD112 v2 IgV
QDVRVQVLPEVRGQLGGTAELPCHLLPPVPGLHISLVTWQRPDAPANHQNVAAFHPKMGPSFPGPKPGSERLSFVSAKQGTGQDTEAELQDATLALHSLTVEDEGYYTCEFVTFPKGSVRGMTWL

SEQ ID NO: 784 - protein, 125 aa, Artificial Sequence
  CD112 v3 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 785 - protein, 125 aa, Artificial Sequence
  CD112 v4 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFITFPKGSVRGMTWL

SEQ ID NO: 786 - protein, 125 aa, Artificial Sequence
  CD112 v5 IgV
QDVRVQVLPEVRGQLGGTVELPCHLLPSVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 787 - protein, 125 aa, Artificial Sequence
  CD112 v6 IgV
QDVRVQVLPEVRGQLGGTVELPCHLLAPVPGLYISLVNWQRPDAPANHQNVAAFHPKMGPSFPSPKPGSERLSFVSAKQSTGQDTEAELQDATLALHGLTAEDEGNYTCEFVTFPKGSVRGMTWL

SEQ ID NO: 788 - protein, 125 aa, Artificial Sequence
  CD112 v7 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWL

SEQ ID NO: 789 - protein, 125 aa, Artificial Sequence
  CD112 v8 IgV
QDVRVQVLPEVWGQLGGTVELPCHLLPPVPGLYISLVTWQRPDAPANYQNVAASHPKMGPSFPSPKPGSERLSFVSAKQSTGQDTEAELQDATLALHGLTVEDEGNYTCEFATFPKGFVRGMTWL

SEQ ID NO: 790 - protein, 125 aa, Artificial Sequence
  CD112 v9 IgV
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWL

SEQ ID NO: 791 - protein, 125 aa, Artificial Sequence
  CD112 v10 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFASFPKGYVRGMTWL

SEQ ID NO: 792 - protein, 125 aa, Artificial Sequence
  CD112 v11 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGYVRGMTWL

SEQ ID NO: 793 - protein, 125 aa, Artificial Sequence
  CD112 v12 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGYVRGMTWL

SEQ ID NO: 794 - protein, 125 aa, Artificial Sequence
  CD112 v13 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGFVRGMTWL

SEQ ID NO: 795 - protein, 125 aa, Artificial Sequence
  CD112 v14 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLTPHGLTVEDEGNYTCEFATFPKGYVRGMTWL

SEQ ID NO: 796 - protein, 125 aa, Artificial Sequence
  CD112 v15 IgV
QDVRVQVLPEVRGQLGGTVELPCHLLPPVPGLHISLVTWQRPDAPANHQNVAAFHPKMGPSFPSPKSGSERLSFVSAKQSTGQDTEAELQDATLALHGLTVEDEGYYTCEFVTFPKGSVRGMTWL

SEQ ID NO: 797 - protein, 125 aa, Artificial Sequence
  CD112 v16 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGSVRGMTWL

SEQ ID NO: 798 - protein, 125 aa, Artificial Sequence
  CD112 v17 IgV
QDVRVQVLPEVRGQLGGSVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 799 - protein, 125 aa, Artificial Sequence
  CD112 v18 IgV
QDVRVQVLSEVRGQLGGTVELPCHLLPPVPGLHISLVTWQRPDAPASHQNVAAFHPKMGPSFPSPKPGSERLSFVSAKQSTGQDTEAELQDATLALHGLTVEDEGNYTCEFVTFPKGSVRGMTWL

SEQ ID NO: 800 - protein, 125 aa, Artificial Sequence
  CD112 v19 IgV
QDVRVQVLPEVRGQLGGTVELPCHLLPPVPGLYISLVTWQRSDAPANHQNVAAFHPKMGPSFPSPKHGSERLSFVSAKQSTGQDTEAELQDATLALHGLTVEDEGNYTCEFVTFPKGSVRGMTWL

SEQ ID NO: 801 - protein, 125 aa, Artificial Sequence
  CD112 v20 IgV
QDVRVQVLPEVRGQLGGTVELPCHLLLPVPGPYISLVTWQRSDAPANHQNVAAFHPKMGPSFPSPKPGSERLSFVSAKQSTGQDTEAELQDATLALHGLTVEDEGNYTCEFVTFPKGSVRGMTWL

SEQ ID NO: 802 - protein, 125 aa, Artificial Sequence
  CD112 v21 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHDLTVEDEGNYTCEFVTFPKGSVRGMTWL

SEQ ID NO: 803 - protein, 125 aa, Artificial Sequence
  CD112 v22 IgV
QDVRVQVLPEVRGQLGGTVELPCHLLPPVPGLHIPLVTWQRPDAPANHQNVAAFHPKMGPSFPSPKPGSERLSFVSAKQSTGQDTEAELQDATLALHGLTVEDEGYYTCEFVTFPKGSVRGMTWL

SEQ ID NO: 804 - protein, 125 aa, Artificial Sequence
  CD112 v23 IgV
QDVRVQVLPEVRGQLGGTVELPCHLLPPVPGPYISLVTWQRSDAPANHQNVAAFHPKMGPSFPSPKPGSERLSFVSAKQSTGQDTEAELQDATLALHGLAVEDEGNYTCEFVTFPKGSVRGMTWL

SEQ ID NO: 805 - protein, 125 aa, Artificial Sequence
  CD112 v24 IgV
QDVRVQVLPEVRGQLGGTVELPCHLLSPVPGLYISLVTWQRPDASANHQNVAAFHPKMGPSFPSPKPGSERLSFVSAKQSTGQDTEAELQDATLALHGLTVEDEGIYTCEFVTFPKGSVRGMTWL

SEQ ID NO: 806 - protein, 125 aa, Artificial Sequence
  CD112 v25 IgV
QDVRVQVLPEVRGQLGGTVELPCHLLPPVPGLHISLVTWQRPDAPAKHQNVAAFHPKMGPSFPSPKPGSERLSFVSAKQSTGQDTEAELQDATLALHGLTVEDEGNYTCEFVTFPKGSVRGMTWL

SEQ ID NO: 807 - protein, 125 aa, Artificial Sequence
  CD112 v26 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGSVRGMTWL

SEQ ID NO: 808 - protein, 125 aa, Artificial Sequence
  CD112 v27 IgV
QDVRVQVLPEVRGQLGGTVELPCHLLPPVPGLYISLVTWQRPDAPANHQNVAAFHPKMGPSFPSPKPGSERLSFVSARQSTGQGTEAELQDATLALHGLTVEDEGNYTCEFVTSPKGSVRGMTWL

SEQ ID NO: 809 - protein, 125 aa, Artificial Sequence
  CD112 v28 IgV
QDVRVQVLPEVRGQLGGTVELPCHLLPPVPGLHISLVTWQRPDAPAKHQNVAALHPKMGPSFPSPKPGSERLSFVSAKQSTGQDTEAELQDATLALHGLTVEDEGNYTCEFVTFPKGSVRGMTWL

SEQ ID NO: 810 - protein, 125 aa, Artificial Sequence
  CD112 v29 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 811 - protein, 125 aa, Artificial Sequence
  CD112 v30 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFVTFPKGSVRGMTWL

SEQ ID NO: 812 - protein, 125 aa, Artificial Sequence
  CD112 v31 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 813 - protein, 125 aa, Artificial Sequence
  CD112 v32 IgV
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 814 - protein, 125 aa, Artificial Sequence
  CD112 v33 IgV
QDVRVQVLPEVRGQLGGTVELPCHLLPPVPGLHISLVTWQRPDAPANHQNMAAFHPKMGPSFPSPKPGSERLSFVSAKQSTGQDTEAELQDATLALHGLTVEDEGNYTCEFVTFPKGSVRGMTWL

SEQ ID NO: 815 - protein, 125 aa, Artificial Sequence
  CD112 v34 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTVRGMTWL

SEQ ID NO: 816 - protein, 125 aa, Artificial Sequence
  CD112 v35 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTAEDEGNYTCEFVTFSKGSVRGMTWL

SEQ ID NO: 817 - protein, 125 aa, Artificial Sequence
  CD112 v36 IgV
QDVRVQVLPEVRGQLGGTVELPCRLLPPVPGLYISLVNWQRPGAPANHQNVAAFHPKMGPSFPSPKPGSERLSFVSAKQSTGQDTEAELQDATLALHGLTVEDEGNYTCEFVTFPKGSVRGMTWL

SEQ ID NO: 818 - protein, 125 aa, Artificial Sequence
  CD112 v37 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 819 - protein, 125 aa, Artificial Sequence
  CD112 v38 IgV
QDVRVQVLPEVRGQLGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 820 - protein, 125 aa, Artificial Sequence
  CD112 v39 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWL

SEQ ID NO: 821 - protein, 125 aa, Artificial Sequence
  CD112 v40 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGITWL

SEQ ID NO: 822 - protein, 125 aa, Artificial Sequence
  CD112 v41 IgV
QDVRVQVLPEVRGQLGGTVELPCHLLPPVPGLYISLVTWQRPDAPANHQNVAAFHPKMGPSFPSPKPGSERLSFVSAKQSTGKDTEAELQDATLALHGLTVEDEGYYTCEFVTFPKGSVRGMTWL

SEQ ID NO: 823 - protein, 125 aa, Artificial Sequence
  CD112 v42 IgV
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWL

SEQ ID NO: 824 - protein, 125 aa, Artificial Sequence
  CD112 v43 IgV
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 825 - protein, 125 aa, Artificial Sequence
  CD112 v44 IgV
QDVRVQVLPEVRGQLGGTVELPCHLLSPVPGLYISLVTWQRPDAPANHQNVAAFHPKMGPSFPSPKPGSERLSFVSAKQSTGQDTEAELRDATLALHGLTVEDEGNYTCEFVTFPKGSVRGMTWL

SEQ ID NO: 826 - protein, 125 aa, Artificial Sequence
  CD112 v45 IgV
QDVRVQVLPEVRGQVGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWL

SEQ ID NO: 827 - protein, 125 aa, Artificial Sequence
  CD112 v46 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYICEFVTFPKGSVRGMTWL

SEQ ID NO: 828 - protein, 125 aa, Artificial Sequence
  CD112 v47 IgV
QDVRVQVLPEVRGQLGGTVELPCHLLPPVPGLHISLVTWQRPDAPANHQNVAAFHLKMGPSFPSPKPGSERLSFMSAKQSTGQDTEAELQDATLALHGLTMEDEGNYTCEFVTFPKGSVRGMTWL

SEQ ID NO: 829 - protein, 127 aa, Homo sapiens
  MISC_FEATURE: CD112 IgV Wildtype
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRV

SEQ ID NO: 830 - protein, 127 aa, Artificial Sequence
  CD112 v1 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKDSVRGMTWLRV

SEQ ID NO: 831 - protein, 127 aa, Artificial Sequence
  CD112 v2 IgV
QDVRVQVLPEVRGQLGGTAELPCHLLPPVPGLHISLVTWQRPDAPANHQNVAAFHPKMGPSFPGPKPGSERLSFVSAKQGTGQDTEAELQDATLALHSLTVEDEGYYTCEFVTFPKGSVRGMTWLRV

SEQ ID NO: 832 - protein, 127 aa, Artificial Sequence
  CD112 v3 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 833 - protein, 127 aa, Artificial Sequence
  CD112 v4 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFITFPKGSVRGMTWLRV

SEQ ID NO: 834 - protein, 127 aa, Artificial Sequence
  CD112 v5 IgV
QDVRVQVLPEVRGQLGGTVELPCHLLPSVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 835 - protein, 127 aa, Artificial Sequence
  CD112 v6 IgV
QDVRVQVLPEVRGQLGGTVELPCHLLAPVPGLYISLVNWQRPDAPANHQNVAAFHPKMGPSFPSPKPGSERLSFVSAKQSTGQDTEAELQDATLALHGLTAEDEGNYTCEFVTFPKGSVRGMTWLRV

SEQ ID NO: 836 - protein, 127 aa, Artificial Sequence
  CD112 v7 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 837 - protein, 127 aa, Artificial Sequence
  CD112 v8 IgV
QDVRVQVLPEVWGQLGGTVELPCHLLPPVPGLYISLVTWQRPDAPANYQNVAASHPKMGPSFPSPKPGSERLSFVSAKQSTGQDTEAELQDATLALHGLTVEDEGNYTCEFATFPKGFVRGMTWLRV

SEQ ID NO: 838 - protein, 127 aa, Artificial Sequence
  CD112 v9 IgV
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWLRV

SEQ ID NO: 839 - protein, 127 aa, Artificial Sequence
  CD112 v10 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFASFPKGYVRGMTWLRV

SEQ ID NO: 840 - protein, 127 aa, Artificial Sequence
  CD112 v11 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGYVRGMTWLRV

SEQ ID NO: 841 - protein, 127 aa, Artificial Sequence
  CD112 v12 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGYVRGMTWLRV

SEQ ID NO: 842 - protein, 127 aa, Artificial Sequence
  CD112 v13 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGFVRGMTWLRV

SEQ ID NO: 843 - protein, 127 aa, Artificial Sequence
  CD112 v14 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLTPHGLTVEDEGNYTCEFATFPKGYVRGMTWLRV

SEQ ID NO: 844 - protein, 127 aa, Artificial Sequence
  CD112 v15 IgV
QDVRVQVLPEVRGQLGGTVELPCHLLPPVPGLHISLVTWQRPDAPANHQNVAAFHPKMGPSFPSPKSGSERLSFVSAKQSTGQDTEAELQDATLALHGLTVEDEGYYTCEFVTFPKGSVRGMTWLRV

SEQ ID NO: 845 - protein, 127 aa, Artificial Sequence
  CD112 v16 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGSVRGMTWLRV

SEQ ID NO: 846 - protein, 127 aa, Artificial Sequence
  CD112 v17 IgV
QDVRVQVLPEVRGQLGGSVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 847 - protein, 127 aa, Artificial Sequence
  CD112 v18 IgV
QDVRVQVLSEVRGQLGGTVELPCHLLPPVPGLHISLVTWQRPDAPASHQNVAAFHPKMGPSFPSPKPGSERLSFVSAKQSTGQDTEAELQDATLALHGLTVEDEGNYTCEFVTFPKGSVRGMTWLRV

SEQ ID NO: 848 - protein, 127 aa, Artificial Sequence
  CD112 v19 IgV
QDVRVQVLPEVRGQLGGTVELPCHLLPPVPGLYISLVTWQRSDAPANHQNVAAFHPKMGPSFPSPKHGSERLSFVSAKQSTGQDTEAELQDATLALHGLTVEDEGNYTCEFVTFPKGSVRGMTWLRV

SEQ ID NO: 849 - protein, 127 aa, Artificial Sequence
  CD112 v20 IgV
QDVRVQVLPEVRGQLGGTVELPCHLLLPVPGPYISLVTWQRSDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 850 - protein, 127 aa, Artificial Sequence
  CD112 v21 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHDLTVEDEGNYTCEFVTFPKGSVRGMTWLRV

SEQ ID NO: 851 - protein, 127 aa, Artificial Sequence
  CD112 v22 IgV
QDVRVQVLPEVRGQLGGTVELPCHLLPPVPGLHIPLVTWQRPDAPANHQNVAAFHPKMGPSFPSPKPGSERLSFVSAKQSTGQDTEAELQDATLALHGLTVEDEGYYTCEFVTFPKGSVRGMTWLRV

SEQ ID NO: 852 - protein, 127 aa, Artificial Sequence
  CD112 v23 IgV
QDVRVQVLPEVRGQLGGTVELPCHLLPPVPGPYISLVTWQRSDAPANHQNVAAFHPKMGPSFPSPKPGSERLSFVSAKQSTGQDTEAELQDATLALHGLAVEDEGNYTCEFVTFPKGSVRGMTWLRV

SEQ ID NO: 853 - protein, 127 aa, Artificial Sequence
  CD112 v24 IgV
QDVRVQVLPEVRGQLGGTVELPCHLLSPVPGLYISLVTWQRPDASANHQNVAAFHPKMGPSFPSPKPGSERLSFVSAKQSTGQDTEAELQDATLALHGLTVEDEGIYTCEFVTFPKGSVRGMTWLRV

SEQ ID NO: 854 - protein, 127 aa, Artificial Sequence
  CD112 v25 IgV
QDVRVQVLPEVRGQLGGTVELPCHLLPPVPGLHISLVTWQRPDAPAKHQNVAAFHPKMGPSFPSPKPGSERLSFVSAKQSTGQDTEAELQDATLALHGLTVEDEGNYTCEFVTFPKGSVRGMTWLRV

SEQ ID NO: 855 - protein, 127 aa, Artificial Sequence
  CD112 v26 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGSVRGMTWLRV

SEQ ID NO: 856 - protein, 127 aa, Artificial Sequence
  CD112 v27 IgV
QDVRVQVLPEVRGQLGGTVELPCHLLPPVPGLYISLVTWQRPDAPANHQNVAAFHPKMGPSFPSPKPGSERLSFVSARQSTGQGTEAELQDATLALHGLTVEDEGNYTCEFVTSPKGSVRGMTWLRV

SEQ ID NO: 857 - protein, 127 aa, Artificial Sequence
  CD112 v28 IgV
QDVRVQVLPEVRGQLGGTVELPCHLLPPVPGLHISLVTWQRPDAPAKHQNVAALHPKMGPSFPSPKPGSERLSFVSAKQSTGQDTEAELQDATLALHGLTVEDEGNYTCEFVTFPKGSVRGMTWLRV

SEQ ID NO: 858 - protein, 127 aa, Artificial Sequence
  CD112 v29 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 859 - protein, 127 aa, Artificial Sequence
  CD112 v30 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFVTFPKGSVRGMTWLRV

SEQ ID NO: 860 - protein, 127 aa, Artificial Sequence
  CD112 v31 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 861 - protein, 127 aa, Artificial Sequence
  CD112 v32 IgV
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 862 - protein, 127 aa, Artificial Sequence
  CD112 v33 IgV
QDVRVQVLPEVRGQLGGTVELPCHLLPPVPGLHISLVTWQRPDAPANHQNMAAFHPKMGPSFPSPKPGSERLSFVSAKQSTGQDTEAELQDATLALHGLTVEDEGNYTCEFVTFPKGSVRGMTWLRV

SEQ ID NO: 863 - protein, 127 aa, Artificial Sequence
  CD112 v34 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTVRGMTWLRV

SEQ ID NO: 864 - protein, 127 aa, Artificial Sequence
  CD112 v35 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTAEDEGNYTCEFVTFSKGSVRGMTWLRV

SEQ ID NO: 865 - protein, 127 aa, Artificial Sequence
  CD112 v36 IgV
QDVRVQVLPEVRGQLGGTVELPCRLLPPVPGLYISLVNWQRPGAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 866 - protein, 127 aa, Artificial Sequence
  CD112 v37 gV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 867 - protein, 127 aa, Artificial Sequence
  CD112 v38 gV
QDVRVQVLPEVRGQLGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 868 - protein, 127 aa, Artificial Sequence
  CD112 v39 gV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRV

SEQ ID NO: 869 - protein, 127 aa, Artificial Sequence
  CD112 v40 gV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGITWLRV

SEQ ID NO: 870 - protein, 127 aa, Artificial Sequence
  CD112 v41 gV
QDVRVQVLPEVRGQLGGTVELPCHLLPPVPGLYISLVTWQRPDAPANHQNVAAFHPKMGPSFPSPKPGSERLSFVSAKQSTGKDTEAELQDATLALHGLTVEDEGYYTCEFVTFPKGSVRGMTWLRV

SEQ ID NO: 871 - protein, 127 aa, Artificial Sequence
  CD112 v42 gV
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRV

SEQ ID NO: 872 - protein, 127 aa, Artificial Sequence
  CD112 v43 gV
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 873 - protein, 127 aa, Artificial Sequence
  CD112 v44 gV
QDVRVQVLPEVRGQLGGTVELPCHLLSPVPGLYISLVTWQRPDAPANHQNVAAFHPKMGPSFPSPKPGSERLSFVSAKQSTGQDTEAELRDATLALHGLTVEDEGNYTCEFVTFPKGSVRGMTWLRV

SEQ ID NO: 874 - protein, 127 aa, Artificial Sequence
  CD112 v45 IgV
QDVRVQVLPEVRGQVGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRV

SEQ ID NO: 875 - protein, 127 aa, Artificial Sequence
  CD112 v46 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYICEFVTFPKGSVRGMTWLRV

SEQ ID NO: 876 - protein, 127 aa, Artificial Sequence
  CD112 v47 IgV
QDVRVQVLPEVRGQLGGTVELPCHLLPPVPGLHISLVTWQRPDAPANHQNVAAFHLKMGPSFPSPKPGSERLSFMSAKQSTGQDTEAELQDATLALHGLTMEDEGNYTCEFVTFPKGSVRGMTWLRV

SEQ ID NO: 877 - protein, 329 aa, Artificial Sequence
  CD112 v48 ECD
QDVRVQVLPEVRGQLGGTVELPCHLLPPVPGLYISLVTWQRPDAPAKHQNVAAFHPKMGPSFPSPKPGSERLSFVSAKRSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 878 - protein, 329 aa, Artificial Sequence
  CD112 v49 ECD
QDVRVQVLPEVRGQLGGTVELPCHLLPPVPGLYISLVTWRRPDAPANHQNVAAFHPKMGTSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 879 - protein, 329 aa, Artificial Sequence
  CD112 v50 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATYPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 880 - protein, 329 aa, Artificial Sequence
  CD112 v51 ECD
QDVRVQVLPEVRGQLGGTVELPCHLLPPVPGLHISLVTWQRPDAPANHQNVAAFHPKMGPSFPSPKPGSERLSFVSARQSTGQDTEAELQDATLALHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 881 - protein, 329 aa, Artificial Sequence
  CD112 v52 ECD
QDVRVQVLPEVWGQLGGTVELPCHLLPPVPGLYISLVTWQRPDAPTNHQNVAAFHPKMGPSFPSPMPGSERLSFVSAKRSTGQDTEAELQDATLALHGLTVEDEGIYTCEFAAFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 882 - protein, 329 aa, Artificial Sequence
  CD112 v53 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 883 - protein, 329 aa, Artificial Sequence
  CD112 v54 ECD
QDVRVQVLPEVWGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 884 - protein, 329 aa, Artificial Sequence
  CD112 v55 ECD
QDVRVQVLPEVRGQVGGTVELPCHLLPPVPGLYISLVTWQRPDAPANHQNVAAFHPKMGPSFPSPKPGSERLSFVSAKQSTGQDTEAELRDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 885 - protein, 329 aa, Artificial Sequence; identical to SEQ ID NO: 884
  CD112 v56 ECD

SEQ ID NO: 886 - protein, 329 aa, Artificial Sequence
  CD112 v57 ECD
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 887 - protein, 329 aa, Artificial Sequence
  CD112 v58 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 888 - protein, 329 aa, Artificial Sequence
  CD112 v59 ECD
QDVRVQVLPEVRGQLGGAVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 889 - protein, 329 aa, Artificial Sequence
  CD112 v60 ECD
QDVRVQVLPEVRGQVGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 890 - protein, 329 aa, Artificial Sequence
  CD112 v61 ECD
QDVRVQVLPEVRGQLGGTVELPCHLLPPVPGLYISLMTWQRPDAPANHQNVAAFHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 891 - protein, 329 aa, Artificial Sequence
  CD112 v62 ECD
QDVRVQVLPEVRGQLGGTVELPCHLLPPVPGLYISLVTWQRPDAPAKHQNVAAFHPKMGPSFPSPKPGSERLSFVSAKQSTGQDTEAELQDATLALHGLTVEDEGNYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 892 - protein, 329 aa, Artificial Sequence
  CD112 v63 ECD
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 893 - protein, 329 aa, Artificial Sequence
  CD112 v64 ECD
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 894 - protein, 329 aa, Artificial Sequence
  CD112 v65 ECD
QDVRVQVLPEVRGQLGGTVELPCHLLPPVSGLHISLVTWQRPDAPAKHQNVAAFHPKMGPSFPSPKPGSERLSFMSAKRSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 895 - protein, 329 aa, Artificial Sequence
  CD112 v66 ECD
QDVRVQVLPEVRGQLGGTAELPCHLLPPVPGLYISLVTWQRPDAPAKHQNVAAFHPKMGPSFPSPKPGSERLSFVSAKQSTGQDTEAELQDATLALHGLTVEDEGYYTCEFATFPEGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 896 - protein, 329 aa, Artificial Sequence
  CD112 v67 ECD
QDVRVQVLPEVRGQLGGTVELPCHLLPPVPGLYISLVTWQRPDAPANHQNVAAFHPKMGPSFPSPKPGSERLSFVSAKRSTGQDAEAELQDATLALHGLTVEDEGNYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 897 - protein, 329 aa, Artificial Sequence
  CD112 v68 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 898 - protein, 329 aa, Artificial Sequence
  CD112 v69 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 899 - protein, 329 aa, Artificial Sequence
  CD112 v70 ECD
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 900 - protein, 329 aa, Artificial Sequence
  CD112 v71 ECD
QDVRVQVLPEVRGQLGGTVELPCHLLPPVPGLHISLVTWQRPDAPTNHQNVAAFHPKMGPSFPSPKPGSERLSFVSAKRSTGQDTEAELQDATLALHGLTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 901 - protein, 329 aa, Artificial Sequence
  CD112 v72 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRSMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 902 - protein, 329 aa, Artificial Sequence
  CD112 v73 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 903 - protein, 329 aa, Artificial Sequence
  CD112 v74 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 904 - protein, 329 aa, Artificial Sequence
  CD112 v75 ECD
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTMEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 905 - protein, 329 aa, Artificial Sequence
  CD112 v76 ECD
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGMTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 906 - protein, 329 aa, Artificial Sequence
  CD112 v77 ECD
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYACEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 907 - protein, 329 aa, Artificial Sequence
  CD112 v78 ECD
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 908 - protein, 329 aa, Artificial Sequence
  CD112 v79 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCGFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 909 - protein, 329 aa, Artificial Sequence
  CD112 v80 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 910 - protein, 329 aa, Artificial Sequence
  CD112 v81 ECD
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 911 - protein, 329 aa, Artificial Sequence
  CD112 v82 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHDLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 912 - protein, 329 aa, Artificial Sequence
  CD112 v83 ECD
QDVRVQVLPEVRGQLGGTVELPCHLLPPVPGLYISLVTWQRPDAPAKHQNVAAFHPKMGPSFPSPKPGSERLSFVSAKQSSGQDTEAELQDATLALHGLTMEDEGNYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 913 - protein, 329 aa, Artificial Sequence
  CD112 v84 ECD
QDVRVQVLPEVRGQLGGTVELPCHLLPPVPGLYISLVTWQRPDAPANHQNVAAFHPKMGPSFPSPKPGSERLSFVSAKQSTSQDTEAELQDATLALHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 914 - protein, 329 aa, Artificial Sequence
  CD112 v85 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 915 - protein, 329 aa, Artificial Sequence
  CD112 v86 ECD
QDVRVQVLPEVRGQLGGTVELPCHLLPPVPGLHISLVTWQRPDAPAKHQNVAAFHPKMGPSFPSPKPGSERLSFVSAKRSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 916 - protein, 329 aa, Artificial Sequence
  CD112 v87 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFATFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 917 - protein, 329 aa, Artificial Sequence
  CD112 v88 ECD
QDVRVQVLPEVWGQLGGTVELPCHLLPPVPGLHISLVTWQRPDAPANHQNVAAFHPKMGPSFPSPKPGSERLSFVSAKRSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 918 - protein, 125 aa, Artificial Sequence
  CD112 v48 IgV
QDVRVQVLPEVRGQLGGTVELPCHLLPPVPGLYISLVTWQRPDAPAKHQNVAAFHPKMGPSFPSPKPGSERLSFVSAKRSTGQDTEAELQDATLALHGLTVEDEGNYTCEFATFPKGFVRGMTWL

SEQ ID NO: 919 - protein, 125 aa, Artificial Sequence
  CD112 v49 IgV
QDVRVQVLPEVRGQLGGTVELPCHLLPPVPGLYISLVTWRRPDAPANHQNVAAFHPKMGTSFPSPKPGSERLSFVSAKQSTGQDTEAELQDATLALHGLTVEDEGNYTCEFVTFPKGTVRGMTWL

SEQ ID NO: 920 - protein, 125 aa, Artificial Sequence
  CD112 v50 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATYPKGFVRGMTWL

SEQ ID NO: 921 - protein, 125 aa, Artificial Sequence
  CD112 v51 IgV
QDVRVQVLPEVRGQLGGTVELPCHLLPPVPGLHISLVTWQRPDAPANHQNVAAFHPKMGPSFPSPKPGSERLSFVSARQSTGQDTEAELQDATLALHGLTVEDEGNYTCEFATFPKGYVRGMTWL

SEQ ID NO: 922 - protein, 125 aa, Artificial Sequence
  CD112 v52 IgV
QDVRVQVLPEVWGQLGGTVELPCHLLPPVPGLYISLVTWQRPDAPTNHQNVAAFHPKMGPSFPSPMPGSERLSFVSAKRSTGQDTEAELQDATLALHGLTVEDEGIYTCEFAAFPKGFVRGMTWL

SEQ ID NO: 923 - protein, 125 aa, Artificial Sequence
  CD112 v53 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGFVRGMTWL

SEQ ID NO: 924 - protein, 125 aa, Artificial Sequence
  CD112 v54 IgV
QDVRVQVLPEVWGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGFVRGMTWL

SEQ ID NO: 925 - protein, 125 aa, Artificial Sequence
  CD112 v55 IgV
QDVRVQVLPEVRGQVGGTVELPCHLLPPVPGLYISLVTWQRPDAPANHQNVAAFHPKMGPSFPSPKPGSERLSFVSAKQSTGQDTEAELRDATLALHGLTVEDEGNYTCEFATFPKGFVRGMTWL

SEQ ID NO: 926 - protein, 125 aa, Artificial Sequence
  CD112 v56 IgV
QDVRVQVLPEVRGQLGGTVELPCHLLPPVPGLYISLVTWQRPDAPAKHQNVAAFHPKMGPSFPSPKPGSERLSFVSAKQSTGQGTEAELQDATLALHGLTVEDEGIYTCEFATFPKGYVRGMTWL

SEQ ID NO: 927 - protein, 125 aa, Artificial Sequence
  CD112 v57 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFATFPKGFVRGMTWL

SEQ ID NO: 928 - protein, 125 aa, Artificial Sequence
  CD112 v58 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFVTFPKGYVRGMTWL

SEQ ID NO: 929 - protein, 125 aa, Artificial Sequence
  CD112 v59 IgV
QDVRVQVLPEVRGQLGGAVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGTVRGMTWL

SEQ ID NO: 930 - protein, 125 aa, Artificial Sequence
  CD112 v60 IgV
QDVRVQVLPEVRGQVGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGFVRGMTWL

SEQ ID NO: 931 - protein, 125 aa, Artificial Sequence
  CD112 v61 IgV
QDVRVQVLPEVRGQLGGTVELPCHLLPPVPGLYISLMTWQRPDAPANHQNVAAFHPKMGPSFPSPKPGSERLSFVSAKQSTGQDTEAELQDATLALHGLTVEDEGNYTCEFATFPKGFVRGMTWL

SEQ ID NO: 932 - protein, 125 aa, Artificial Sequence
  CD112 v62 IgV
QDVRVQVLPEVRGQLGGTVELPCHLLPPVPGLYISLVTWQRPDAPAKHQNVAAFHPKMGPSFPSPKPGSERLSFVSAKQSTGQDTEAELQDATLALHGLTVEDEGNYTCEFVTFPKGYVRGMTWL

SEQ ID NO: 933 - protein, 125 aa, Artificial Sequence
  CD112 v63 IgV
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTVEDEGNYTCEFVTFPKGSVRGMTWL

SEQ ID NO: 934 - protein, 125 aa, Artificial Sequence
  CD112 v64 IgV
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGIYTCEFATFPKGYVRGMTWL

SEQ ID NO: 935 - protein, 125 aa, Artificial Sequence
  CD112 v65 IgV
QDVRVQVLPEVRGQLGGTVELPCHLLPPVSGLHISLVTWQRPDAPAKHQNVAAFHPKMGPSFPSPKPGSERLSFMSAKRSTGQDTEAELQDATLALHGLTVEDEGIYTCEFATFPKGYVRGMTWL

SEQ ID NO: 936 - protein, 125 aa, Artificial Sequence
  CD112 v66 IgV
QDVRVQVLPEVRGQLGGTAELPCHLLPPVPGLYISLVTWQRPDAPAKHQNVAAFHPKMGPSFPSPKPGSERLSFVSAKQSTGQDTEAELQDATLALHGLTVEDEGYYTCEFATFPEGYVRGMTWL

SEQ ID NO: 937 - protein, 125 aa, Artificial Sequence
  CD112 v67 IgV
QDVRVQVLPEVRGQLGGTVELPCHLLPPVPGLYISLVTWQRPDAPANHQNVAAFHPKMGPSFPSPKPGSERLSFVSAKRSTGQDAEAELQDATLALHGLTVEDEGNYTCEFVTFPKGYVRGMTWL

SEQ ID NO: 938 - protein, 125 aa, Artificial Sequence
  CD112 v68 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWL

SEQ ID NO: 939 - protein, 125 aa, Artificial Sequence
  CD112 v69 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFVTFPKGTVRGMTWL

SEQ ID NO: 940 - protein, 125 aa, Artificial Sequence
  CD112 v70 IgV
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWL

SEQ ID NO: 941 - protein, 125 aa, Artificial Sequence
  CD112 v71 IgV
QDVRVQVLPEVRGQLGGTVELPCHLLPPVPGLHISLVTWQRPDAPTNHQNVAAFHPKMGPSFPSPKPGSERLSFVSAKRSTGQDTEAELQDATLALHGLTVEDEGIYTCEFATFPKGFVRGMTWL

SEQ ID NO: 942 - protein, 125 aa, Artificial Sequence
  CD112 v72 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRSMTWL

SEQ ID NO: 943 - protein, 125 aa, Artificial Sequence
  CD112 v73 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFATFPKGYVRGMTWL

SEQ ID NO: 944 - protein, 125 aa, Artificial Sequence
  CD112 v74 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGSVRGMTWL

SEQ ID NO: 945 - protein, 125 aa, Artificial Sequence
  CD112 v75 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTMEDEGNYTCEFVTFPKGTVRGMTWL

SEQ ID NO: 946 - protein, 125 aa, Artificial Sequence
  CD112 v76 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGMTVEDEGIYTCEFATFPKGFVRGMTWL

SEQ ID NO: 947 - protein, 125 aa, Artificial Sequence
  CD112 v77 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYACEFATFPKGFVRGMTWL

SEQ ID NO: 948 - protein, 125 aa, Artificial Sequence
  CD112 v78 IgV
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWL

SEQ ID NO: 949 - protein, 125 aa, Artificial Sequence
  CD112 v79 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCGFVTFPKGSVRGMTWL

SEQ ID NO: 950 - protein, 125 aa, Artificial Sequence
  CD112 v80 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGYVRGMTWL

SEQ ID NO: 951 - protein, 125 aa, Artificial Sequence
  CD112 v81 IgV
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWL

SEQ ID NO: 952 - protein, 125 aa, Artificial Sequence
  CD112 v82 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHDLTMEDEGNYTCEFVTFPKGSVRGMTWL

SEQ ID NO: 953 - protein, 125 aa, Artificial Sequence
  CD112 v83 IgV
QDVRVQVLPEVRGQLGGTVELPCHLLPPVPGLYISLVTWQRPDAPAKHQNVAAFHPKMGPSFPSPKPGSERLSFVSAKQSSGQDTEAELQDATLALHGLTMEDEGNYTCEFVTFPKGFVRGMTWL

SEQ ID NO: 954 - protein, 125 aa, Artificial Sequence
  CD112 v84 IgV
QDVRVQVLPEVRGQLGGTVELPCHLLPPVPGLYISLVTWQRPDAPANHQNVAAFHPKMGPSFPSPKPGSERLSFVSAKQSTSQDTEAELQDATLALHGLTVEDEGNYTCEFATFPKGYVRGMTWL

SEQ ID NO: 955 - protein, 125 aa, Artificial Sequence
  CD112 v85 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGYVRGMTWL

SEQ ID NO: 956 - protein, 125 aa, Artificial Sequence
  CD112 v86 IgV
QDVRVQVLPEVRGQLGGTVELPCHLLPPVPGLHISLVTWQRPDAPAKHQNVAAFHPKMGPSFPSPKPGSERLSFVSAKRSTGQDTEAELQDATLALHGLTVEDEGYYTCEFVTFPKGSVRGMTWL

SEQ ID NO: 957 - protein, 125 aa, Artificial Sequence
  CD112 v87 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFATFPKGTVRGMTWL

SEQ ID NO: 958 - protein, 125 aa, Artificial Sequence
  CD112 v88 IgV
QDVRVQVLPEVWGQLGGTVELPCHLLPPVPGLHISLVTWQRPDAPANHQNVAAFHPKMGPSFPSPKPGSERLSFVSAKRSTGQDTEAELQDATLALHGLTMEDEGNYTCEFVTFPKGSVRGMTWL

SEQ ID NO: 959 - protein, 127 aa, Artificial Sequence
  CD112 v48 IgV
QDVRVQVLPEVRGQLGGTVELPCHLLPPVPGLYISLVTWQRPDAPAKHQNVAAFHPKMGPSFPSPKPGSERLSFVSAKRSTGQDTEAELQDATLALHGLTVEDEGNYTCEFATFPKGFVRGMTWLRV

SEQ ID NO: 960 - protein, 127 aa, Artificial Sequence
  CD112 v49 IgV
QDVRVQVLPEVRGQLGGTVELPCHLLPPVPGLYISLVTWRRPDAPANHQNVAAFHPKMGTSFPSPKPGSERLSFVSAKQSTGQDTEAELQDATLALHGLTVEDEGNYTCEFVTFPKGTVRGMTWLRV

SEQ ID NO: 961 - protein, 127 aa, Artificial Sequence
  CD112 v50 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATYPKGFVRGMTWLRV

SEQ ID NO: 962 - protein, 127 aa, Artificial Sequence
  CD112 v51 IgV
QDVRVQVLPEVRGQLGGTVELPCHLLPPVPGLHISLVTWQRPDAPANHQNVAAFHPKMGPSFPSPKPGSERLSFVSARQSTGQDTEAELQDATLALHGLTVEDEGNYTCEFATFPKGYVRGMTWLRV

SEQ ID NO: 963 - protein, 127 aa, Artificial Sequence
  CD112 v52 IgV
QDVRVQVLPEVWGQLGGTVELPCHLLPPVPGLYISLVTWQRPDAPTNHQNVAAFHPKMGPSFPSPMPGSERLSFVSAKRSTGQDTEAELQDATLALHGLTVEDEGIYTCEFAAFPKGFVRGMTWLRV

SEQ ID NO: 964 - protein, 127 aa, Artificial Sequence
  CD112 v53 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGFVRGMTWLRV

SEQ ID NO: 965 - protein, 127 aa, Artificial Sequence
  CD112 v54 IgV
QDVRVQVLPEVWGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGFVRGMTWLRV

SEQ ID NO: 966 - protein, 127 aa, Artificial Sequence
  CD112 v55 IgV
QDVRVQVLPEVRGQVGGTVELPCHLLPPVPGLYISLVTWQRPDAPANHQNVAAFHPKMGPSFPSPKPGSERLSFVSAKQSTGQDTEAELRDATLALHGLTVEDEGNYTCEFATFPKGFVRGMTWLRV

SEQ ID NO: 967 - protein, 127 aa, Artificial Sequence
  CD112 v56 IgV
QDVRVQVLPEVRGQLGGTVELPCHLLPPVPGLYISLVTWQRPDAPAKHQNVAAFHPKMGPSFPSPKPGSERLSFVSAKQSTGQGTEAELQDATLALHGLTVEDEGIYTCEFATFPKGYVRGMTWLRV

SEQ ID NO: 968 - protein, 127 aa, Artificial Sequence
  CD112 v57 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 969 - protein, 127 aa, Artificial Sequence
  CD112 v58 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFVTFPKGYVRGMTWLRV

SEQ ID NO: 970 - protein, 127 aa, Artificial Sequence
  CD112 v59 IgV
QDVRVQVLPEVRGQLGGAVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGTVRGMTWLRV

SEQ ID NO: 971 - protein, 127 aa, Artificial Sequence
  CD112 v60 IgV
QDVRVQVLPEVRGQVGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGFVRGMTWLRV

SEQ ID NO: 972 - protein, 127 aa, Artificial Sequence
  CD112 v61 IgV
QDVRVQVLPEVRGQLGGTVELPCHLLPPVPGLYISLMTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 973 - protein, 127 aa, Artificial Sequence
  CD112 v62 IgV
QDVRVQVLPEVRGQLGGTVELPCHLLPPVPGLYISLVTWQRPDAPAKHQNVAAFHPKMGPSFPSPKPGSERLSFVSAKQSTGQDTEAELQDATLALHGLTVEDEGNYTCEFVTFPKGYVRGMTWLRV

SEQ ID NO: 974 - protein, 127 aa, Artificial Sequence
  CD112 v63 IgV
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTVEDEGNYTCEFVTFPKGSVRGMTWLRV

SEQ ID NO: 975 - protein, 127 aa, Artificial Sequence
  CD112 v64 IgV
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGIYTCEFATFPKGYVRGMTWLRV

SEQ ID NO: 976 - protein, 127 aa, Artificial Sequence
  CD112 v65 IgV
QDVRVQVLPEVRGQLGGTVELPCHLLPPVSGLHISLVTWQRPDAPAKHQNVAAFHPKMGPSFPSPKPGSERLSFMSAKRSTGQDTEAELQDATLALHGLTVEDEGIYTCEFATFPKGYVRGMTWLRV

SEQ ID NO: 977 - protein, 127 aa, Artificial Sequence
  CD112 v66 IgV
QDVRVQVLPEVRGQLGGTAELPCHLLPPVPGLYISLVTWQRPDAPAKHQNVAAFHPKMGPSFPSPKPGSERLSFVSAKQSTGQDTEAELQDATLALHGLTVEDEGYYTCEFATFPEGYVRGMTWLRV

SEQ ID NO: 978 - protein, 127 aa, Artificial Sequence
  CD112 v67 IgV
QDVRVQVLPEVRGQLGGTVELPCHLLPPVPGLYISLVTWQRPDAPANHQNVAAFHPKMGPSFPSPKPGSERLSFVSAKRSTGQDAEAELQDATLALHGLTVEDEGNYTCEFVTFPKGYVRGMTWLRV

SEQ ID NO: 979 - protein, 127 aa, Artificial Sequence
  CD112 v68 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWLRV

SEQ ID NO: 980 - protein, 127 aa, Artificial Sequence
  CD112 v69 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFVTFPKGTVRGMTWLRV

SEQ ID NO: 981 - protein, 127 aa, Artificial Sequence
  CD112 v70 IgV
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWLRV

SEQ ID NO: 982 - protein, 127 aa, Artificial Sequence
  CD112 v71 IgV
QDVRVQVLPEVRGQLGGTVELPCHLLPPVPGLHISLVTWQRPDAPTNHQNVAAFHPKMGPSFPSPKPGSERLSFVSAKRSTGQDTEAELQDATLALHGLTVEDEGIYTCEFATFPKGFVRGMTWLRV

SEQ ID NO: 983 - protein, 127 aa, Artificial Sequence
  CD112 v72 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRSMTWLRV

SEQ ID NO: 984 - protein, 127 aa, Artificial Sequence
  CD112 v73 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFATFPKGYVRGMTWLRV

SEQ ID NO: 985 - protein, 127 aa, Artificial Sequence
  CD112 v74 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGSVRGMTWLRV

SEQ ID NO: 986 - protein, 127 aa, Artificial Sequence
  CD112 v75 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTMEDEGNYTCEFVTFPKGTVRGMTWLRV

SEQ ID NO: 987 - protein, 127 aa, Artificial Sequence
  CD112 v76 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGMTVEDEGIYTCEFATFPKGFVRGMTWLRV

SEQ ID NO: 988 - protein, 127 aa, Artificial Sequence
  CD112 v77 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYACEFATFPKGFVRGMTWLRV

SEQ ID NO: 989 - protein, 127 aa, Artificial Sequence
  CD112 v78 IgV
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWLRV

SEQ ID NO: 990 - protein, 127 aa, Artificial Sequence
  CD112 v79 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCGFVTFPKGSVRGMTWLRV

SEQ ID NO: 991 - protein, 127 aa, Artificial Sequence
  CD112 v80 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGYVRGMTWLRV

SEQ ID NO: 992 - protein, 127 aa, Artificial Sequence
  CD112 v81 IgV
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWLRV

SEQ ID NO: 993 - protein, 127 aa, Artificial Sequence
  CD112 v82 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHDLTMEDEGNYTCEFVTFPKGSVRGMTWLRV

SEQ ID NO: 994 - protein, 127 aa, Artificial Sequence
  CD112 v83 IgV
QDVRVQVLPEVRGQLGGTVELPCHLLPPVPGLYISLVTWQRPDAPAKHQNVAAFHPKMGPSFPSPKPGSERLSFVSAKQSSGQDTEAELQDATLALHGLTMEDEGNYTCEFVTFPKGFVRGMTWLRV

SEQ ID NO: 995 - protein, 127 aa, Artificial Sequence
  CD112 v84 IgV
QDVRVQVLPEVRGQLGGTVELPCHLLPPVPGLYISLVTWQRPDAPANHQNVAAFHPKMGPSFPSPKPGSERLSFVSAKQSTSQDTEAELQDATLALHGLTVEDEGNYTCEFATFPKGYVRGMTWLRV

SEQ ID NO: 996 - protein, 127 aa, Artificial Sequence
  CD112 v85 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGYVRGMTWLRV

SEQ ID NO: 997 - protein, 127 aa, Artificial Sequence
  CD112 v86 IgV
QDVRVQVLPEVRGQLGGTVELPCHLLPPVPGLHISLVTWQRPDAPAKHQNVAAFHPKMGPSFPSPKPGSERLSFVSAKRSTGQDTEAELQDATLALHGLTVEDEGYYTCEFVTFPKGSVRGMTWLRV

SEQ ID NO: 998 - protein, 127 aa, Artificial Sequence
  CD112 v87 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFATFPKGTVRGMTWLRV

SEQ ID NO: 999 - protein, 127 aa, Artificial Sequence
  CD112 v88 IgV
QDVRVQVLPEVWGQLGGTVELPCHLLPPVPGLHISLVTWQRPDAPANHQNVAAFHPKMGPSFPSPKPGSERLSFVSAKRSTGQDTEAELQDATLALHGLTMEDEGNYTCEFVTFPKGSVRGMTWLRV

SEQ ID NO: 1000 - protein, 107 aa, Artificial Sequence
  PD-L1 IgV
PKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKV

SEQ ID NO: 1001 - protein, 220 aa, Artificial Sequence
  PD-L1 ECD v1
FTVTVPKDLYVVEYGSNMTIECKFPVENQLDLAALIVYWEVEDKTIIQFVNGEEDLEVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1002 - protein, 220 aa, Artificial Sequence
  PD-L1 ECD v2
FTVTVPKDLYVVEYGSNMTLECKFPVEKQLDLAALTVYWEMEDKDITQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1003 - protein, 220 aa, Artificial Sequence
  PD-L1 ECD v3
FTVTVPKDLYVVEYGSNMTLECKFPVEKQLDLAALIVYWEKEDENIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1004 - protein, 220 aa, Artificial Sequence
  PD-L1 ECD v4
FTVTVSKDLYVVEYGSNMTIECKFPVEKQLDLAALIVYWEMEDKTIIQFVHGEEDLKVQHSSYRQRARLLKDQLSLGIAALQTTDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1005 - protein, 220 aa, Artificial Sequence
  PD-L1 ECD v5
FTVTVPKDLYVVEYGSNMTIECKFPVEKQLDLAALIVYWEMEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1006 - protein, 220 aa, Artificial Sequence
  PD-L1 ECD v6
FTVTVPKDLYVVEYGSNMTIECKFPVEKQLDLAALIVYWEKEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1007 - protein, 220 aa, Artificial Sequence
  PD-L1 ECD v7
FTVTVPKDLYVVEYGSNMTIECKFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1008 - protein, 220 aa, Artificial Sequence
  PD-L1 ECD v8
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1009 - protein, 220 aa, Artificial Sequence
  PD-L1 ECD v9
FTVTVPKDLYVVEYGSNMTIECKFPVEKQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1010 - protein, 220 aa, Artificial Sequence
  PD-L1 ECD v10
FTVTVPKDLYVVEYGSNMTIECKFPVEKQLDLAALIVYWEKEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1011 - protein, 220 aa, Artificial Sequence
  PD-L1 ECD v11
FTVTVPKDLYVVEYGSNMTLECKFPVEKQLDLAALTVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1012 - protein, 220 aa, Artificial Sequence
  PD-L1 ECD v12
FTVTVPKDLYVVEYGSDMTIECKFPVEKQLDLAALIVYWEMEDKTIIQFAHGEEDLKVQHSSYRQRARLLKGQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1013 - protein, 220 aa, Artificial Sequence
  PD-L1 ECD v13
FTVTVPKDLYVVEYGSNMTLECKFPVEKQLDLAALIVYWEMEDKNIIQSVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1014 - protein, 220 aa, Artificial Sequence
  PD-L1 ECD v14
FTVTVPKDLYVVEYGSNMTIECKFPVEKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1015 - protein, 220 aa, Artificial Sequence
  PD-L1 ECD v15
FTVTVPKDLYVVEYGSNMTLECKFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1016 - protein, 220 aa, Artificial Sequence
  PD-L1 ECD v16
FTVTVPKDLYVVEYGSNMTLECKFPVEKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1017 - protein, 220 aa, Artificial Sequence
  PD-L1 ECD v17
FTVTVPKDLYVVEYGSNMTIECKFPVEKQLDLAALIVYWEVEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1018 - protein, 220 aa, Artificial Sequence
  PD-L1 ECD v18
FTVTVPKDLYVVEYGSNMTIECKFPVEKQLDLAALIVYWEKEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1019 - protein, 220 aa, Artificial Sequence
  PD-L1 ECD v19
FTVTVPKDLYVVEYGSNMTIECKFPVEKQLDLDALIVYWEMEDKNIIQFVHGEEDLKVQHSSYRQRARLLKDQLPLGNAALQITEVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1020 - protein, 220 aa, Artificial Sequence
  PD-L1 ECD v20
FTVTVPKDLYVVEYGSNITIECKFPVEKQLDLAALIVYWEKEGKNIIQFVRGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1021 - protein, 220 aa, Artificial Sequence
  PD-L1 ECD v21
FTVTVPKDLYEVEYGSNMTLECKFPVEKQLDLAALTVYWEMEDKDIIQFVHGEEDLKVQRSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1022 - protein, 220 aa, Artificial Sequence
  PD-L1 ECD v22
FTVTVPKDLYVVEYGSNMTIECKFPVEKQLDLDALIVYWEMEDKNIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1023 - protein, 220 aa, Artificial Sequence
  PD-L1 ECD v23
FTVTVPKDLYVVEYGGNMTIECKFPVEKQLDLDALIVYWEMEDKNIIQFVHGEEDLKVQHSSYRQRARLLEDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1024 - protein, 220 aa, Artificial Sequence
  PD-L1 ECD v24
FTVTVPKDLYVVEYGSNMTIECKFPVGKQLDLAALIVYWEMEDKTIIQFVHGEEDLKVQHSSYRQRARLLKDQLSLGNAALQITDVKLQDAGVYRCIISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1025 - protein, 220 aa, Artificial Sequence
  PD-L1 ECD v25
FTVTVPKDLYVVEYGSNMTIECKFPVGKQLDLAALIVYWEMEDKTIIQFVHGEEDLRVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1026 - protein, 220 aa, Artificial Sequence
  PD-L1 ECD v26
FTVTVPKDLYVVEYGSNMTIECKFPVEKQLDLDALIVYWEMEDKNIIQFVHGVEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1027 - protein, 220 aa, Artificial Sequence
  PD-L1 ECD v27
FTVTVPKDLYVVEYGSNMTIECKFPVEKQLDLAALIVYWEMEGKDIIQFVHGEEDLKAQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1028 - protein, 220 aa, Artificial Sequence
  PD-L1 ECD v28
FTVTVPKDLYVVEYGSNMTIECKFPVEKQLDLAALIVYWGMEVKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1029 - protein, 220 aa, Artificial Sequence
  PD-L1 ECD v29
FTVTVPKDLYVVESGSNMTIECKFPVEEQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1030 - protein, 220 aa, Artificial Sequence
  PD-L1 ECD v30
FTVTVPKDLYVVEYGSNMTIECKFPVEKQLDLDALIVYWEMEDKNIIQFVHGEEDLKVQHSSYRQRARLLKDQLSLGSAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1031 - protein, 220 aa, Artificial Sequence
  PD-L1 ECD v31
FTVTVPKDLYVVEYGSNMTIECKFPVEKQLDLDALIVYWEMEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1032 - protein, 220 aa, Artificial Sequence
  PD-L1 ECD v32
FTVTVPKDLYVVEYGSNMTIECKFPVEKQLDLDALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1033 - protein, 220 aa, Artificial Sequence
  PD-L1 ECD v33
FTVTVPKDLYVVEYGSNMTIECKFPVEKQLDLDALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1034 - protein, 220 aa, Artificial Sequence
  PD-L1 ECD v34
FTVTVPKDLYVVEYGSNMTIECKFPVGKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1035 - protein, 220 aa, Artificial Sequence
  PD-L1 ECD v35
FTVTVPKDLYVVEYGSNMTIECKFPVEKQLDLAALIVYWEMEDKTIIQFAHGEEDLKVQHSSYRQRARLLKDQLSLGSAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1036 - protein, 220 aa, Artificial Sequence
  PD-L1 ECD v36
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITMKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1037 - protein, 220 aa, Artificial Sequence
  PD-L1 ECD v37
FTVTVPKDLYVVEYGSNMTLECKFPVEKQLDLAALTVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1038 - protein, 220 aa, Artificial Sequence
  PD-L1 ECD v38
FTVTVPKDLYVVEYGSNMTIECKFPVEKQLDLAALIVYWEMEDKTIIQFVHGEEDLKVQHSSYRQRARLLKDQPPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1039 - protein, 220 aa, Artificial Sequence
  PD-L1 ECD v39
FTVTVPKDLYVVEYGSNMTIECKFPVEKQLDLAALIVYWEMEDKTIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1040 - protein, 220 aa, Artificial Sequence
  PD-L1 ECD v40
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYRRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1041 - protein, 220 aa, Artificial Sequence
  PD-L1 ECD v41
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1042 - protein, 220 aa, Artificial Sequence
  PD-L1 ECD v42
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCVISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1043 - protein, 220 aa, Artificial Sequence
  PD-L1 ECD v43
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGAGYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1044 - protein, 220 aa, Artificial Sequence
  PD-L1 ECD v44
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1045 - protein, 220 aa, Artificial Sequence
  PD-L1 ECD v45
FTVTVPKDLYVVEYGSNMTLECKFPVGKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1046 - protein, 220 aa, Artificial Sequence
  PD-L1 ECD v46
FTVTVPKDLYVVEYGSNMTLECKFPVGKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1047 - protein, 220 aa, Artificial Sequence
  PD-L1 ECD v47
FTVTVPKDLYVVEYGSNMTLECKFPVEKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1048 - protein, 220 aa, Artificial Sequence
  PD-L1 ECD v48
FTVTVPKDLYVVEYGSNMTLECKFPVEKQLDLDALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1049 - protein, 220 aa, Artificial Sequence
  PD-L1 ECD v49
FTVTVPKDLYVVEYGSNMTLECKFPVEKQLDLAALIVYWEMEGKDIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1050 - protein, 220 aa, Artificial Sequence
  PD-L1 ECD v50
FTVTVPKDLYVVEYGSNMTIECKFPVGKQLDLAALIVYWEMEDKTIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1051 - protein, 220 aa, Artificial Sequence
  PD-L1 ECD v51
FTVTVPKDLYVVEYGSNMTIECKFPVEKQLDLAALIVYWEMEDKTIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1052 - protein, 220 aa, Artificial Sequence
  PD-L1 ECD v52
FTVTVPKDLYAVEYGSNMTLECKFPVGKQLDLAALIVYWEMEGKDIIQFVYGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1053 - protein, 220 aa, Artificial Sequence
  PD-L1 ECD v53
FTVTVPKDLYVVEYGSNMTLECKFPVGKQLDLAALIVYWEMEGKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1054 - protein, 220 aa, Artificial Sequence
  PD-L1 ECD v54
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1055 - protein, 220 aa, Artificial Sequence; identical to SEQ ID NO: 1011
  PD-L1 ECD v55

SEQ ID NO: 1056 - protein, 220 aa, Artificial Sequence
  PD-L1 ECD v56
FTVTVPKDLYVVEYGSNMTLECKFPVEEQLDLAALIVYWEMEGKDIIQFVHGGEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1057 - protein, 220 aa, Artificial Sequence
  PD-L1 ECD v57
FTVTVPKDLYVVEYGSNMTIECKFPVEKQLDLDALIVYWEMEGKDIIQFVHGEEDLKAQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1058 - protein, 220 aa, Artificial Sequence
  PD-L1 ECD v58
FTVTVPKDLYVVEYGSNMTIECRFPVEKQLDLAALIVYWEMEGKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1059 - protein, 220 aa, Artificial Sequence
  PD-L1 ECD v59
FTVTVPKDLYVVEYGSNMTLECKFPVEKQLDLAALIVYWEMEGKDIIQFVHGEEDLKAQHSSYRQRARLLKDQLSLGIAALQITDVKLQGAGVYRCMISYDGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1060 - protein, 221 aa, Artificial Sequence
  PD-L1 ECD v60
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1061 - protein, 220 aa, Artificial Sequence
  PD-L1 ECD v61
FTVTVPKDLYVVEYGSNMTLECEFPVEKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1062 - protein, 220 aa, Artificial Sequence
  PD-L1 ECD v62
FTVTVPKDLYVVEYGSNMTLECEFPVEKQLDLAALIVYWEMEGKDIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1063 - protein, 220 aa, Artificial Sequence
  PD-L1 ECD v63
FTVTVPKDLYVVEYGSNMIIECKFPVGKQLDLAALIVYWEMEDKIIIQFAHGEEDLKVQHSSYRQRARLLKDQLSLGIAALQITDVKLQDAGVYRCKISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1064 - protein, 220 aa, Artificial Sequence
  PD-L1 ECD v64
FTVTVPKDLYVVEYGSNMTLECKFPVEKQLDLAALIVYWEKEGKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1065 - protein, 220 aa, Artificial Sequence
  PD-L1 ECD v65
FTVTVPKDLYVVEYGSNMTIECRFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1066 - protein, 107 aa, Artificial Sequence
  PD-L1 IgV v1
PKDLYVVEYGSNMTIECKFPVENQLDLAALIVYWEVEDKTIIQFVNGEEDLEVQHSSYRQRARLLKDQLSLGNAALQITDVKLQDAGVYRCMISYGGADYKRITVKV

SEQ ID NO: 1067 - protein, 107 aa, Artificial Sequence
  PD-L1 IgV v2
PKDLYVVEYGSNMTLECKFPVEKQLDLAALTVYWEMEDKDITQFVHGEEDLKVQHSSYRQRARLLKDQLSLGNAALQITDVKLQDAGVYRCMISYGGADYKRITVKV

SEQ ID NO: 1068 - protein, 107 aa, Artificial Sequence
  PD-L1 IgV v3
PKDLYVVEYGSNMTLECKFPVEKQLDLAALIVYWEKEDENIIQFVHGEEDLKVQHSSYRQRARLLKDQLSLGNAALQITDVKLQDAGVYRCMISYGGADYKRITVKV

SEQ ID NO: 1069 - protein, 107 aa, Artificial Sequence
  PD-L1 IgV v4
SKDLYVVEYGSNMTIECKFPVEKQLDLAALIVYWEMEDKTIIQFVHGEEDLKVQHSSYRQRARLLKDQLSLGIAALQTTDVKLQDAGVYRCMISYGGADYKRITVKV

SEQ ID NO: 1070 - protein, 107 aa, Artificial Sequence
  PD-L1 IgV v5
PKDLYVVEYGSNMTIECKFPVEKQLDLAALIVYWEMEDKNIIQFVHGEEDLKVQHSSYRQRARLLKDQLSLGIAALQITDVKLQDAGVYRCMISYGGADYKRITVKV

SEQ ID NO: 1071 - protein, 107 aa, Artificial Sequence
  PD-L1 IgV v6
PKDLYVVEYGSNMTIECKFPVEKQLDLAALIVYWEKEDKNIIQFVHGEEDLKVQHSSYRQRARLLKDQLSLGIAALQITDVKLQDAGVYRCMISYGGADYKRITVKV

SEQ ID NO: 1072 - protein, 107 aa, Artificial Sequence
  PD-L1 IgV v7
PKDLYVVEYGSNMTIECKFPVEKQLDLAALIVYWEMEDKTIIQFVHGEEDLKVQHSSYRQRARLLKDQLSLGIAALQITDVKLQDAGVYRCMISYGGADYKRITVKV

SEQ ID NO: 1073 - protein, 107 aa, Artificial Sequence
  PD-L1 IgV v8
PKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITVKV

SEQ ID NO: 1074 - protein, 107 aa, Artificial Sequence
  PD-L1 IgV v9
PKDLYVVEYGSNMTIECKFPVEKQLDLAALIVYWEMEDKTIIQFVHGEEDLKVQHSSYRQRARLLKDQLSLGNAALQITDVKLQDAGVYRCMISYGGADYKRITVKV

SEQ ID NO: 1075 - protein, 107 aa, Artificial Sequence
  PD-L1 IgV v10
PKDLYVVEYGSNMTIECKFPVEKQLDLAALIVYWEKEDKNIIQFVHGEEDLKVQHSSYRQRARLLKDQLSLGNAALQITDVKLQDAGVYRCMISYGGADYKRITVKV

SEQ ID NO: 1076 - protein, 107 aa, Artificial Sequence
  PD-L1 IgV v11
PKDLYVVEYGSNMTLECKFPVEKQLDLAALTVYWEMEDKDIIQFVHGEEDLKVQHSSYRQRARLLKDQLSLGNAALQITDVKLQDAGVYRCMISYGGADYKRITVKV

SEQ ID NO: 1077 - protein, 107 aa, Artificial Sequence
  PD-L1 IgV v12
PKDLYVVEYGSDMTIECKFPVEKQLDLAALIVYWEMEDKTIIQFAHGEEDLKVQHSSYRQRARLLKGQLSLGNAALQITDVKLQDAGVYRCMISYGGADYKRITVKV

SEQ ID NO: 1078 - protein, 107 aa, Artificial Sequence
  PD-L1 IgV v13
PKDLYVVEYGSNMTLECKFPVEKQLDLAALIVYWEMEDKNIIQSVHGEEDLKVQHSSYRQRARLLKDQLSLGNAALQITDVKLQDAGVYRCMISYGGADYKRITVKV

SEQ ID NO: 1079 - protein, 107 aa, Artificial Sequence
  PD-L1 IgV v14
PKDLYVVEYGSNMTIECKFPVEKQLDLAALIVYWEMEDKTIIQFAHGEEDLKVQHSSYRQRARLLKDQLSLGNAALQITDVKLQDAGVYRCMISYGGADYKRITVKV

SEQ ID NO: 1080 - protein, 107 aa, Artificial Sequence
  PD-L1 IgV v15
PKDLYVVEYGSNMTLECKFPVEKQLDLAALIVYWEMEDKTIIQFVHGEEDLKVQHSSYRQRARLLKDQLSLGIAALQITDVKLQDAGVYRCMISYGGADYKRITVKV

SEQ ID NO: 1081 - protein, 107 aa, Artificial Sequence
  PD-L1 IgV v16
PKDLYVVEYGSNMTLECKFPVEKQLDLAALIVYWEMEDKTIIQFAHGEEDLKVQHSSYRQRARLLKDQLSLGNAALQITDVKLQDAGVYRCMISYGGADYKRITVKV

SEQ ID NO: 1082 - protein, 107 aa, Artificial Sequence
  PD-L1 IgV v17
PKDLYVVEYGSNMTIECKFPVEKQLDLAALIVYWEVEDKTIIQFVHGEEDLKVQHSSYRQRARLLKDQLSLGNAALQITDVKLQDAGVYRCMISYGGADYKRITVKV

SEQ ID NO: 1083 - protein, 107 aa, Artificial Sequence
  PD-L1 IgV v18
PKDLYVVEYGSNMTIECKFPVEKQLDLAALIVYWEKEDKTIIQFVHGEEDLKVQHSSYRQRARLLKDQLSLGNAALQITDVKLQDAGVYRCMISYGGADYKRITVKV

SEQ ID NO: 1084 - protein, 107 aa, Artificial Sequence
  PD-L1 IgV v19
PKDLYVVEYGSNMTIECKFPVEKQLDLDALIVYWEMEDKNIIQFVHGEEDLKVQHSSYRQRARLLKDQLPLGNAALQITEVKLQDAGVYRCMISYGGADYKRITVKV

SEQ ID NO: 1085 - protein, 107 aa, Artificial Sequence
  PD-L1 IgV v20
PKDLYVVEYGSNITIECKFPVEKQLDLAALIVYWEKEGKNIIQFVRGEEDLKVQHSSYRQRARLLKDQLSLGIAALQITDVKLQDAGVYRCMISYGGADYKRITVKV

SEQ ID NO: 1086 - protein, 107 aa, Artificial Sequence
  PD-L1 IgV v21
PKDLYEVEYGSNMTLECKFPVEKQLDLAALTVYWEMEDKDIIQFVHGEEDLKVQRSSYRQRARLLKDQLPLGNAALQITDVKLQDAGVYRCMISYGGADYKRITVKV

SEQ ID NO: 1087 - protein, 107 aa, Artificial Sequence
  PD-L1 IgV v22
PKDLYVVEYGSNMTIECKFPVEKQLDLDALIVYWEMEDKNIIQFAHGEEDLKVQHSSYRQRARLLKDQLSLGNAALQITDVKLQDAGVYRCMISYGGADYKRITVKV

SEQ ID NO: 1088 - protein, 107 aa, Artificial Sequence
  PD-L1 IgV v23
PKDLYVVEYGGNMTIECKFPVEKQLDLDALIVYWEMEDKNIIQFVHGEEDLKVQHSSYRQRARLLEDQLPLGNAALQITDVKLQDAGVYRCMISYGGADYKRITVKV

SEQ ID NO: 1089 - protein, 107 aa, Artificial Sequence
  PD-L1 IgV v24
PKDLYVVEYGSNMTIECKFPVGKQLDLAALIVYWEMEDKTIIQFVHGEEDLKVQHSSYRQRARLLKDQLSLGNAALQITDVKLQDAGVYRCIISYGGADYKRITVKV

SEQ ID NO: 1090 - protein, 107 aa, Artificial Sequence
  PD-L1 IgV v25
PKDLYVVEYGSNMTIECKFPVGKQLDLAALIVYWEMEDKTIIQFVHGEEDLRVQHSSYRQRARLLKDQLSLGNAALQITDVKLQDAGVYRCMISYGGADYKRITVKV

SEQ ID NO: 1091 - protein, 107 aa, Artificial Sequence
  PD-L1 IgV v26
PKDLYVVEYGSNMTIECKFPVEKQLDLDALIVYWEMEDKNIIQFVHGVEDLKVQHSSYRQRARLLKDQLSLGNAALQITDVKLQDAGVYRCMISYGGADYKRITVKV

SEQ ID NO: 1092 - protein, 107 aa, Artificial Sequence
  PD-L1 IgV v27
PKDLYVVEYGSNMTIECKFPVEKQLDLAALIVYWEMEGKDIIQFVHGEEDLKAQHSSYRQRARLLKDQLSLGNAALQITDVKLQDAGVYRCMISYGGADYKRITVKV

SEQ ID NO: 1093 - protein, 107 aa, Artificial Sequence
  PD-L1 IgV v28
PKDLYVVEYGSNMTIECKFPVEKQLDLAALIVYWGMEVKTIIQFAHGEEDLKVQHSSYRQRARLLKDQLSLGNAALQITDVKLQDAGVYRCMISYGGADYKRITVKV

SEQ ID NO: 1094 - protein, 107 aa, Artificial Sequence
  PD-L1 IgV v29
PKDLYVVESGSNMTIECKFPVEEQLDLAALIVYWEMEDKTIIQFVHGEEDLKVQHSSYRQRARLLKDQLSLGNAALQITDVKLQDAGVYRCMISYGGADYKRITVKV

SEQ ID NO: 1095 - protein, 107 aa, Artificial Sequence
  PD-L1 IgV v30
PKDLYVVEYGSNMTIECKFPVEKQLDLDALIVYWEMEDKNIIQFVHGEEDLKVQHSSYRQRARLLKDQLSLGSAALQITDVKLQDAGVYRCMISYGGADYKRITVKV

SEQ ID NO: 1096 - protein, 107 aa, Artificial Sequence
  PD-L1 IgV v31
PKDLYVVEYGSNMTIECKFPVEKQLDLDALIVYWEMEDKNIIQFVHGEEDLKVQHSSYRQRARLLKDQLSLGIAALQITDVKLQDAGVYRCMISYGGADYKRITVKV

SEQ ID NO: 1097 - protein, 107 aa, Artificial Sequence
  PD-L1 IgV v32
PKDLYVVEYGSNMTIECKFPVEKQLDLDALIVYWEMEDKTIIQFVHGEEDLKVQHSSYRQRARLLKDQLSLGNAALQITDVKLQDAGVYRCMISYGGADYKRITVKV

SEQ ID NO: 1098 - protein, 107 aa, Artificial Sequence
  PD-L1 IgV v33
PKDLYVVEYGSNMTIECKFPVEKQLDLDALIVYWEMEDKTIIQFVHGEEDLKVQHSSYRQRARLLKDQLSLGIAALQITDVKLQDAGVYRCMISYGGADYKRITVKV

SEQ ID NO: 1099 - protein, 107 aa, Artificial Sequence
  PD-L1 IgV v34
PKDLYVVEYGSNMTIECKFPVGKQLDLAALIVYWEMEDKTIIQFAHGEEDLKVQHSSYRQRARLLKDQLSLGNAALQITDVKLQDAGVYRCMISYGGADYKRITVKV

SEQ ID NO: 1100 - protein, 107 aa, Artificial Sequence
  PD-L1 IgV v35
PKDLYVVEYGSNMTIECKFPVEKQLDLAALIVYWEMEDKTIIQFAHGEEDLKVQHSSYRQRARLLKDQLSLGSAALQITDVKLQDAGVYRCMISYGGADYKRITVKV

SEQ ID NO: 1101 - protein, 107 aa, Artificial Sequence
  PD-L1 IgV v36
PKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITMKV

SEQ ID NO: 1102 - protein, 107 aa, Artificial Sequence
  PD-L1 IgV v37
PKDLYVVEYGSNMTLECKFPVEKQLDLAALTVYWEMEDKTIIQFAHGEEDLKVQHSSYRQRARLLKDQLSLGNAALQITDVKLQDAGVYRCMISYGGADYKRITVKV

SEQ ID NO: 1103 - protein, 107 aa, Artificial Sequence
  PD-L1 IgV v38
PKDLYVVEYGSNMTIECKFPVEKQLDLAALIVYWEMEDKTIIQFVHGEEDLKVQHSSYRQRARLLKDQPPLGNAALQITDVKLQDAGVYRCMISYGGADYKRITVKV

SEQ ID NO: 1104 - protein, 107 aa, Artificial Sequence
  PD-L1 IgV v39
PKDLYVVEYGSNMTIECKFPVEKQLDLAALIVYWEMEDKTIIQFVHGEEDLKVQHSSYRQRARLLKDQLPLGNAALQITDVKLQDAGVYRCMISYGGADYKRITVKV

SEQ ID NO: 1105 - protein, 107 aa, Artificial Sequence
  PD-L1 IgV v40
PKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYRRITVKV

SEQ ID NO: 1106 - protein, 107 aa, Artificial Sequence
  PD-L1 IgV v41
PKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYKRITVKV

SEQ ID NO: 1107 - protein, 107 aa, Artificial Sequence
  PD-L1 IgV v42
PKDLYVVEYGSNMTIECKFPVEKQLDLDALIVYWEMEDKNIIQFVHGEEDLKVQHSSYRQRARLLKDQLPLGNAALQITDVKLQDAGVYRCVISYGGADYKRITVKV

SEQ ID NO: 1108 - protein, 107 aa, Artificial Sequence
  PD-L1 IgV v43
PKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGAGYKRITVKV

SEQ ID NO: 1109 - protein, 107 aa, Artificial Sequence
  PD-L1 IgV v44
PKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGADYKRITVKV

SEQ ID NO: 1110 - protein, 107 aa, Artificial Sequence
  PD-L1 IgV v45
PKDLYVVEYGSNMTLECKFPVGKQLDLAALIVYWEMEDKTIIQFAHGEEDLKVQHSSYRQRARLLKDQLSLGNAALQITDVKLQDAGVYRCMISYGGADYKRITVKV

SEQ ID NO: 1111 - protein, 107 aa, Artificial Sequence
  PD-L1 IgV v46
PKDLYVVEYGSNMTLECKFPVGKQLDLAALIVYWEMEGKDIIQFVHGEEDLKAQHSSYRQRARLLKDQLSLGIAALQITDVKLQDAGVYRCMISYGGADYKRITVKV

SEQ ID NO: 1112 - protein, 107 aa, Artificial Sequence
  PD-L1 IgV v47
PKDLYVVEYGSNMTLECKFPVEKQLDLAALIVYWEMEGKDIIQFVHGEEDLKAQHSSYRQRARLLKDQLSLGIAALQITDVKLQDAGVYRCMISYGGADYKRITVKV

SEQ ID NO: 1113 - protein, 107 aa, Artificial Sequence
  PD-L1 IgV v48
PKDLYVVEYGSNMTLECKFPVEKQLDLDALIVYWEMEGKDIIQFVHGEEDLKAQHSSYRQRARLLKDQLSLGIAALQITDVKLQDAGVYRCMISYGGADYKRITVKV

SEQ ID NO: 1114 - protein, 107 aa, Artificial Sequence
  PD-L1 IgV v49
PKDLYVVEYGSNMTLECKFPVEKQLDLAALIVYWEMEGKDIIQFVHGEEDLKVQHSSYRQRARLLKDQLSLGIAALQITDVKLQDAGVYRCMISYGGADYKRITVKV

SEQ ID NO: 1115 - protein, 107 aa, Artificial Sequence
  PD-L1 IgV v50
PKDLYVVEYGSNMTIECKFPVGKQLDLAALIVYWEMEDKTIIQFAHGEEDLKVQHSSYRQRARLLKDQLSLGIAALQITDVKLQDAGVYRCMISYGGADYKRITVKV

SEQ ID NO: 1116 - protein, 107 aa, Artificial Sequence
  PD-L1 IgV v51
PKDLYVVEYGSNMTIECKFPVEKQLDLAALIVYWEMEDKTIIQFAHGEEDLKVQHSSYRQRARLLKDQLSLGIAALQITDVKLQDAGVYRCMISYGGADYKRITVKV

SEQ ID NO: 1117 - protein, 107 aa, Artificial Sequence
  PD-L1 IgV v52
PKDLYAVEYGSNMTLECKFPVGKQLDLAALIVYWEMEGKDIIQFVYGEEDLKVQHSSYRQRARLLKDQLSLGNAALQITDVKLQDAGVYRCMIGYGGADYKRITVKV

SEQ ID NO: 1118 - protein, 107 aa, Artificial Sequence
  PD-L1 IgV v53
PKDLYVVEYGSNMTLECKFPVGKQLDLAALIVYWEMEGKTIIQFAHGEEDLKVQHSSYRQRARLLKDQLSLGNAALQITDVKLQDAGVYRCMISYGGADYKRITVKV

SEQ ID NO: 1119 - protein, 107 aa, Artificial Sequence
  PD-L1 IgV v54
PKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGADYKRITVKV

SEQ ID NO: 1120 - protein, 107 aa, Artificial Sequence; identical to SEQ ID NO: 1076
  PD-L1 IgV v55

SEQ ID NO: 1121 - protein, 107 aa, Artificial Sequence
  PD-L1 IgV v56
PKDLYVVEYGSNMTLECKFPVEEQLDLAALIVYWEMEGKDIIQFVHGGEDLKAQHSSYRQRARLLKDQLSLGIAALQITDVKLQDAGVYRCMISYGGADYKRITVKV

SEQ ID NO: 1122 - protein, 107 aa, Artificial Sequence
  PD-L1 IgV v57
PKDLYVVEYGSNMTIECKFPVEKQLDLDALIVYWEMEGKDIIQFVHGEEDLKAQHSSYRQRARLLKDQLPLGNAALQITDVKLQDAGVYRCMISYGGADYKRITVKV

SEQ ID NO: 1123 - protein, 107 aa, Artificial Sequence
  PD-L1 IgV v58
PKDLYVVEYGSNMTIECRFPVEKQLDLAALIVYWEMEGKDIIQFVHGEEDLKVQHSSYRQRARLLKDQLSLGNAALQITDVKLQDAGVYRCMISYGGADYKRITVKV

SEQ ID NO: 1124 - protein, 107 aa, Artificial Sequence
  PD-L1 IgV v59
PKDLYVVEYGSNMTLECKFPVEKQLDLAALIVYWEMEGKDIIQFVHGEEDLKAQHSSYRQRARLLKDQLSLGIAALQITDVKLQGAGVYRCMISYDGADYKRITVKV

SEQ ID NO: 1125 - protein, 108 aa, Artificial Sequence
  PD-L1 IgV v60
PKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKV

SEQ ID NO: 1126 - protein, 107 aa, Artificial Sequence
  PD-L1 IgV v61
PKDLYVVEYGSNMTLECEFPVEKQLDLAALIVYWEMEGKDIIQFVHGEEDLKAQHSSYRQRARLLKDQLSLGIAALQITDVKLQDAGVYRCMISYGGADYKRITVKV

SEQ ID NO: 1127 - protein, 107 aa, Artificial Sequence
  PD-L1 IgV v62
PKDLYVVEYGSNMTLECEFPVEKQLDLAALIVYWEMEGKDIIQFAHGEEDLKVQHSSYRQRARLLKDQLSLGIAALQITDVKLQDAGVYRCMISYGGADYKRITVKV

SEQ ID NO: 1128 - protein, 107 aa, Artificial Sequence
  PD-L1 IgV v63
PKDLYVVEYGSNMIIECKFPVGKQLDLAALIVYWEMEDKIIIQFAHGEEDLKVQHSSYRQRARLLKDQLSLGIAALQITDVKLQDAGVYRCKISYGGADYKRITVKV

SEQ ID NO: 1129 - protein, 107 aa, Artificial Sequence
  PD-L1 IgV v64
PKDLYVVEYGSNMTLECKFPVEKQLDLAALIVYWEKEGKDIIQFVHGEEDLKVQHSSYRQRARLLKDQLSLGNAALQITDVKLQDAGVYRCMISYGGADYKRITVKV

SEQ ID NO: 1130 - protein, 107 aa, Artificial Sequence
  PD-L1 IgV v65
PKDLYVVEYGSNMTIECRFPVEKQLDLAALIVYWEMEDKTIIQFVHGEEDLKVQHSSYRQRARLLKDQLSLGIAALQITDVKLQDAGVYRCMISYGGADYKRITVKV

SEQ ID NO: 1131 - protein, 114 aa, Artificial Sequence
  PD-L1 IgV v1
FTVTVPKDLYVVEYGSNMTIECKFPVENQLDLAALIVYWEVEDKTIIQFVNGEEDLEVQHSSYRQRARLLKDQLSLGNAALQITDVKLQDAGVYRCMISYGGADYKRITVKVNA

SEQ ID NO: 1132 - protein, 114 aa, Artificial Sequence
  PD-L1 IgV v2
FTVTVPKDLYVVEYGSNMTLECKFPVEKQLDLAALTVYWEMEDKDITQFVHGEEDLKVQHSSYRQRARLLKDQLSLGNAALQITDVKLQDAGVYRCMISYGGADYKRITVKVNA

SEQ ID NO: 1133 - protein, 114 aa, Artificial Sequence
  PD-L1 IgV v3
FTVTVPKDLYVVEYGSNMTLECKFPVEKQLDLAALIVYWEKEDENIIQFVHGEEDLKVQHSSYRQRARLLKDQLSLGNAALQITDVKLQDAGVYRCMISYGGADYKRITVKVNA

SEQ ID NO: 1134 - protein, 114 aa, Artificial Sequence
  PD-L1 IgV v4
FTVTVSKDLYVVEYGSNMTIECKFPVEKQLDLAALIVYWEMEDKTIIQFVHGEEDLKVQHSSYRQRARLLKDQLSLGIAALQTTDVKLQDAGVYRCMISYGGADYKRITVKVNA

SEQ ID NO: 1135 - protein, 114 aa, Artificial Sequence
  PD-L1 IgV v5
FTVTVPKDLYVVEYGSNMTIECKFPVEKQLDLAALIVYWEMEDKNIIQFVHGEEDLKVQHSSYRQRARLLKDQLSLGIAALQITDVKLQDAGVYRCMISYGGADYKRITVKVNA

SEQ ID NO: 1136 - protein, 114 aa, Artificial Sequence
  PD-L1 IgV v6
FTVTVPKDLYVVEYGSNMTIECKFPVEKQLDLAALIVYWEKEDKNIIQFVHGEEDLKVQHSSYRQRARLLKDQLSLGIAALQITDVKLQDAGVYRCMISYGGADYKRITVKVNA

SEQ ID NO: 1137 - protein, 114 aa, Artificial Sequence
  PD-L1 IgV v7
FTVTVPKDLYVVEYGSNMTIECKFPVEKQLDLAALIVYWEMEDKTIIQFVHGEEDLKVQHSSYRQRARLLKDQLSLGIAALQITDVKLQDAGVYRCMISYGGADYKRITVKVNA

SEQ ID NO: 1138 - protein, 114 aa, Artificial Sequence
  PD-L1 IgV v8
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITVKVNA

SEQ ID NO: 1139 - protein, 114 aa, Artificial Sequence
  PD-L1 IgV v9
FTVTVPKDLYVVEYGSNMTIECKFPVEKQLDLAALIVYWEMEDKTIIQFVHGEEDLKVQHSSYRQRARLLKDQLSLGNAALQITDVKLQDAGVYRCMISYGGADYKRITVKVNA

SEQ ID NO: 1140 - protein, 114 aa, Artificial Sequence
  PD-L1 IgV v10
FTVTVPKDLYVVEYGSNMTIECKFPVEKQLDLAALIVYWEKEDKNIIQFVHGEEDLKVQHSSYRQRARLLKDQLSLGNAALQITDVKLQDAGVYRCMISYGGADYKRITVKVNA

SEQ ID NO: 1141 - protein, 114 aa, Artificial Sequence
  PD-L1 IgV v11
FTVTVPKDLYVVEYGSNMTLECKFPVEKQLDLAALTVYWEMEDKDIIQFVHGEEDLKVQHSSYRQRARLLKDQLSLGNAALQITDVKLQDAGVYRCMISYGGADYKRITVKVNA

SEQ ID NO: 1142 - protein, 114 aa, Artificial Sequence
  PD-L1 IgV v12
FTVTVPKDLYVVEYGSDMTIECKFPVEKQLDLAALIVYWEMEDKTIIQFAHGEEDLKVQHSSYRQRARLLKGQLSLGNAALQITDVKLQDAGVYRCMISYGGADYKRITVKVNA

SEQ ID NO: 1143 - protein, 114 aa, Artificial Sequence
  PD-L1 IgV v13
FTVTVPKDLYVVEYGSNMTLECKFPVEKQLDLAALIVYWEMEDKNIIQSVHGEEDLKVQHSSYRQRARLLKDQLSLGNAALQITDVKLQDAGVYRCMISYGGADYKRITVKVNA

SEQ ID NO: 1144 - protein, 114 aa, Artificial Sequence
  PD-L1 IgV v14
FTVTVPKDLYVVEYGSNMTIECKFPVEKQLDLAALIVYWEMEDKTIIQFAHGEEDLKVQHSSYRQRARLLKDQLSLGNAALQITDVKLQDAGVYRCMISYGGADYKRITVKVNA

SEQ ID NO: 1145 - protein, 114 aa, Artificial Sequence
  PD-L1 IgV v15
FTVTVPKDLYVVEYGSNMTLECKFPVEKQLDLAALIVYWEMEDKTIIQFVHGEEDLKVQHSSYRQRARLLKDQLSLGIAALQITDVKLQDAGVYRCMISYGGADYKRITVKVNA

SEQ ID NO: 1146 - protein, 114 aa, Artificial Sequence
  PD-L1 IgV v16
FTVTVPKDLYVVEYGSNMTLECKFPVEKQLDLAALIVYWEMEDKTIIQFAHGEEDLKVQHSSYRQRARLLKDQLSLGNAALQITDVKLQDAGVYRCMISYGGADYKRITVKVNA

SEQ ID NO: 1147 - protein, 114 aa, Artificial Sequence
  PD-L1 IgV v17
FTVTVPKDLYVVEYGSNMTIECKFPVEKQLDLAALIVYWEVEDKTIIQFVHGEEDLKVQHSSYRQRARLLKDQLSLGNAALQITDVKLQDAGVYRCMISYGGADYKRITVKVNA

SEQ ID NO: 1148 - protein, 114 aa, Artificial Sequence
  PD-L1 IgV v18
FTVTVPKDLYVVEYGSNMTIECKFPVEKQLDLAALIVYWEKEDKTIIQFVHGEEDLKVQHSSYRQRARLLKDQLSLGNAALQITDVKLQDAGVYRCMISYGGADYKRITVKVNA

SEQ ID NO: 1149 - protein, 114 aa, Artificial Sequence
  PD-L1 IgV v19
FTVTVPKDLYVVEYGSNMTIECKFPVEKQLDLDALIVYWEMEDKNIIQFVHGEEDLKVQHSSYRQRARLLKDQLPLGNAALQITEVKLQDAGVYRCMISYGGADYKRITVKVNA

SEQ ID NO: 1150 - protein, 114 aa, Artificial Sequence
  PD-L1 IgV v20
FTVTVPKDLYVVEYGSNITIECKFPVEKQLDLAALIVYWEKEGKNIIQFVRGEEDLKVQHSSYRQRARLLKDQLSLGIAALQITDVKLQDAGVYRCMISYGGADYKRITVKVNA

SEQ ID NO: 1151 - protein, 114 aa, Artificial Sequence
  PD-L1 IgV v21
FTVTVPKDLYEVEYGSNMTLECKFPVEKQLDLAALTVYWEMEDKDIIQFVHGEEDLKVQRSSYRQRARLLKDQLPLGNAALQITDVKLQDAGVYRCMISYGGADYKRITVKVNA

SEQ ID NO: 1152 - protein, 114 aa, Artificial Sequence
  PD-L1 IgV v22
FTVTVPKDLYVVEYGSNMTIECKFPVEKQLDLDALIVYWEMEDKNIIQFAHGEEDLKVQHSSYRQRARLLKDQLSLGNAALQITDVKLQDAGVYRCMISYGGADYKRITVKVNA

SEQ ID NO: 1153 - protein, 114 aa, Artificial Sequence
  PD-L1 IgV v23
FTVTVPKDLYVVEYGGNMTIECKFPVEKQLDLDALIVYWEMEDKNIIQFVHGEEDLKVQHSSYRQRARLLEDQLPLGNAALQITDVKLQDAGVYRCMISYGGADYKRITVKVNA

SEQ ID NO: 1154 - protein, 114 aa, Artificial Sequence
  PD-L1 IgV v24
FTVTVPKDLYVVEYGSNMTIECKFPVGKQLDLAALIVYWEMEDKTIIQFVHGEEDLKVQHSSYRQRARLLKDQLSLGNAALQITDVKLQDAGVYRCIISYGGADYKRITVKVNA

SEQ ID NO: 1155 - protein, 114 aa, Artificial Sequence
  PD-L1 IgV v25
FTVTVPKDLYVVEYGSNMTIECKFPVGKQLDLAALIVYWEMEDKTIIQFVHGEEDLRVQHSSYRQRARLLKDQLSLGNAALQITDVKLQDAGVYRCMISYGGADYKRITVKVNA

SEQ ID NO: 1156 - protein, 114 aa, Artificial Sequence
  PD-L1 IgV v26
FTVTVPKDLYVVEYGSNMTIECKFPVEKQLDLDALIVYWEMEDKNIIQFVHGVEDLKVQHSSYRQRARLLKDQLSLGNAALQITDVKLQDAGVYRCMISYGGADYKRITVKVNA

SEQ ID NO: 1157 - protein, 114 aa, Artificial Sequence
  PD-L1 IgV v27
FTVTVPKDLYVVEYGSNMTIECKFPVEKQLDLAALIVYWEMEGKDIIQFVHGEEDLKAQHSSYRQRARLLKDQLSLGNAALQITDVKLQDAGVYRCMISYGGADYKRITVKVNA

SEQ ID NO: 1158 - protein, 114 aa, Artificial Sequence
  PD-L1 IgV v28
FTVTVPKDLYVVEYGSNMTIECKFPVEKQLDLAALIVYWGMEVKTIIQFAHGEEDLKVQHSSYRQRARLLKDQLSLGNAALQITDVKLQDAGVYRCMISYGGADYKRITVKVNA

SEQ ID NO: 1159 - protein, 114 aa, Artificial Sequence
  PD-L1 IgV v29
FTVTVPKDLYVVESGSNMTIECKFPVEEQLDLAALIVYWEMEDKTIIQFVHGEEDLKVQHSSYRQRARLLKDQLSLGNAALQITDVKLQDAGVYRCMISYGGADYKRITVKVNA

SEQ ID NO: 1160 - protein, 114 aa, Artificial Sequence
  PD-L1 IgV v30
FTVTVPKDLYVVEYGSNMTIECKFPVEKQLDLDALIVYWEMEDKNIIQFVHGEEDLKVQHSSYRQRARLLKDQLSLGSAALQITDVKLQDAGVYRCMISYGGADYKRITVKVNA

SEQ ID NO: 1161 - protein, 114 aa, Artificial Sequence
  PD-L1 IgV v31
FTVTVPKDLYVVEYGSNMTIECKFPVEKQLDLDALIVYWEMEDKNIIQFVHGEEDLKVQHSSYRQRARLLKDQLSLGIAALQITDVKLQDAGVYRCMISYGGADYKRITVKVNA

SEQ ID NO: 1162 - protein, 114 aa, Artificial Sequence
  PD-L1 IgV v32
FTVTVPKDLYVVEYGSNMTIECKFPVEKQLDLDALIVYWEMEDKTIIQFVHGEEDLKVQHSSYRQRARLLKDQLSLGNAALQITDVKLQDAGVYRCMISYGGADYKRITVKVNA

SEQ ID NO: 1163 - protein, 114 aa, Artificial Sequence
  PD-L1 IgV v33
FTVTVPKDLYVVEYGSNMTIECKFPVEKQLDLDALIVYWEMEDKTIIQFVHGEEDLKVQHSSYRQRARLLKDQLSLGIAALQITDVKLQDAGVYRCMISYGGADYKRITVKVNA

SEQ ID NO: 1164 - protein, 114 aa, Artificial Sequence
  PD-L1 IgV v34
FTVTVPKDLYVVEYGSNMTIECKFPVGKQLDLAALIVYWEMEDKTIIQFAHGEEDLKVQHSSYRQRARLLKDQLSLGNAALQITDVKLQDAGVYRCMISYGGADYKRITVKVNA

SEQ ID NO: 1165 - protein, 114 aa, Artificial Sequence
  PD-L1 IgV v35
FTVTVPKDLYVVEYGSNMTIECKFPVEKQLDLAALIVYWEMEDKTIIQFAHGEEDLKVQHSSYRQRARLLKDQLSLGSAALQITDVKLQDAGVYRCMISYGGADYKRITVKVNA

SEQ ID NO: 1166 - protein, 114 aa, Artificial Sequence
  PD-L1 IgV v36
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITMKVNA

SEQ ID NO: 1167 - protein, 114 aa, Artificial Sequence
  PD-L1 IgV v37
FTVTVPKDLYVVEYGSNMTLECKFPVEKQLDLAALTVYWEMEDKTIIQFAHGEEDLKVQHSSYRQRARLLKDQLSLGNAALQITDVKLQDAGVYRCMISYGGADYKRITVKVNA

SEQ ID NO: 1168 - protein, 114 aa, Artificial Sequence
  PD-L1 IgV v38
FTVTVPKDLYVVEYGSNMTIECKFPVEKQLDLAALIVYWEMEDKTIIQFVHGEEDLKVQHSSYRQRARLLKDQPPLGNAALQITDVKLQDAGVYRCMISYGGADYKRITVKVNA

SEQ ID NO: 1169 - protein, 114 aa, Artificial Sequence
  PD-L1 IgV v39
FTVTVPKDLYVVEYGSNMTIECKFPVEKQLDLAALIVYWEMEDKTIIQFVHGEEDLKVQHSSYRQRARLLKDQLPLGNAALQITDVKLQDAGVYRCMISYGGADYKRITVKVNA

SEQ ID NO: 1170 - protein, 114 aa, Artificial Sequence
  PD-L1 IgV v40
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYRRITVKVNA

SEQ ID NO: 1171 - protein, 114 aa, Artificial Sequence
  PD-L1 IgV v41
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYKRITVKVNA

SEQ ID NO: 1172 - protein, 114 aa, Artificial Sequence
  PD-L1 IgV v42
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCVISYGGADYKRITVKVNA

SEQ ID NO: 1173 - protein, 114 aa, Artificial Sequence
  PD-L1 IgV v43
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGAGYKRITVKVNA

SEQ ID NO: 1174 - protein, 114 aa, Artificial Sequence
  PD-L1 IgV v44
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGADYKRITVKVNA

SEQ ID NO: 1175 - protein, 114 aa, Artificial Sequence
  PD-L1 IgV v45
FTVTVPKDLYVVEYGSNMTLECKFPVGKQLDLAALIVYWEMEDKTIIQFAHGEEDLKVQHSSYRQRARLLKDQLSLGNAALQITDVKLQDAGVYRCMISYGGADYKRITVKVNA

SEQ ID NO: 1176 - protein, 114 aa, Artificial Sequence
  PD-L1 IgV v46
FTVTVPKDLYVVEYGSNMTLECKFPVGKQLDLAALIVYWEMEGKDIIQFVHGEEDLKAQHSSYRQRARLLKDQLSLGIAALQITDVKLQDAGVYRCMISYGGADYKRITVKVNA

SEQ ID NO: 1177 - protein, 114 aa, Artificial Sequence
  PD-L1 IgV v47
FTVTVPKDLYVVEYGSNMTLECKFPVEKQLDLAALIVYWEMEGKDIIQFVHGEEDLKAQHSSYRQRARLLKDQLSLGIAALQITDVKLQDAGVYRCMISYGGADYKRITVKVNA

SEQ ID NO: 1178 - protein, 114 aa, Artificial Sequence
  PD-L1 IgV v48
FTVTVPKDLYVVEYGSNMTLECKFPVEKQLDLDALIVYWEMEGKDIIQFVHGEEDLKAQHSSYRQRARLLKDQLSLGIAALQITDVKLQDAGVYRCMISYGGADYKRITVKVNA

SEQ ID NO: 1179 - protein, 114 aa, Artificial Sequence
  PD-L1 IgV v49
FTVTVPKDLYVVEYGSNMTLECKFPVEKQLDLAALIVYWEMEGKDIIQFVHGEEDLKVQHSSYRQRARLLKDQLSLGIAALQITDVKLQDAGVYRCMISYGGADYKRITVKVNA

SEQ ID NO: 1180 - protein, 114 aa, Artificial Sequence
  PD-L1 IgV v50
FTVTVPKDLYVVEYGSNMTIECKFPVGKQLDLAALIVYWEMEDKTIIQFAHGEEDLKVQHSSYRQRARLLKDQLSLGIAALQITDVKLQDAGVYRCMISYGGADYKRITVKVNA

SEQ ID NO: 1181 - protein, 114 aa, Artificial Sequence
  PD-L1 IgV v51
FTVTVPKDLYVVEYGSNMTIECKFPVEKQLDLAALIVYWEMEDKTIIQFAHGEEDLKVQHSSYRQRARLLKDQLSLGIAALQITDVKLQDAGVYRCMISYGGADYKRITVKVNA

SEQ ID NO: 1182 - protein, 114 aa, Artificial Sequence
  PD-L1 IgV v52
FTVTVPKDLYAVEYGSNMTLECKFPVGKQLDLAALIVYWEMEGKDIIQFVYGEEDLKVQHSSYRQRARLLKDQLSLGNAALQITDVKLQDAGVYRCMIGYGGADYKRITVKVNA

SEQ ID NO: 1183 - protein, 114 aa, Artificial Sequence
  PD-L1 IgV v53
FTVTVPKDLYVVEYGSNMTLECKFPVGKQLDLAALIVYWEMEGKTIIQFAHGEEDLKVQHSSYRQRARLLKDQLSLGNAALQITDVKLQDAGVYRCMISYGGADYKRITVKVNA

SEQ ID NO: 1184 - protein, 114 aa, Artificial Sequence
  PD-L1 IgV v54
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGADYKRITVKVNA

SEQ ID NO: 1185 - protein, 114 aa, Artificial Sequence; identical to SEQ ID NO: 1141
  PD-L1 IgV v55

SEQ ID NO: 1186 - protein, 114 aa, Artificial Sequence
  PD-L1 IgV v56
FTVTVPKDLYVVEYGSNMTLECKFPVEEQLDLAALIVYWEMEGKDIIQFVHGGEDLKAQHSSYRQRARLLKDQLSLGIAALQITDVKLQDAGVYRCMISYGGADYKRITVKVNA

SEQ ID NO: 1187 - protein, 114 aa, Artificial Sequence
  PD-L1 IgV v57
FTVTVPKDLYVVEYGSNMTIECKFPVEKQLDLDALIVYWEMEGKDIIQFVHGEEDLKAQHSSYRQRARLLKDQLPLGNAALQITDVKLQDAGVYRCMISYGGADYKRITVKVNA

SEQ ID NO: 1188 - protein, 114 aa, Artificial Sequence
  PD-L1 IgV v58
FTVTVPKDLYVVEYGSNMTIECRFPVEKQLDLAALIVYWEMEGKDIIQFVHGEEDLKVQHSSYRQRARLLKDQLSLGNAALQITDVKLQDAGVYRCMISYGGADYKRITVKVNA

SEQ ID NO: 1189 - protein, 114 aa, Artificial Sequence
  PD-L1 IgV v59
FTVTVPKDLYVVEYGSNMTLECKFPVEKQLDLAALIVYWEMEGKDIIQFVHGEEDLKAQHSSYRQRARLLKDQLSLGIAALQITDVKLQGAGVYRCMISYDGADYKRITVKVNA

SEQ ID NO: 1190 - protein, 115 aa, Artificial Sequence
  PD-L1 IgV v60
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNA

SEQ ID NO: 1191 - protein, 114 aa, Artificial Sequence
  PD-L1 IgV v61
FTVTVPKDLYVVEYGSNMTLECEFPVEKQLDLAALIVYWEMEGKDIIQFVHGEEDLKAQHSSYRQRARLLKDQLSLGIAALQITDVKLQDAGVYRCMISYGGADYKRITVKVNA

SEQ ID NO: 1192 - protein, 114 aa, Artificial Sequence
  PD-L1 IgV v62
FTVTVPKDLYVVEYGSNMTLECEFPVEKQLDLAALIVYWEMEGKDIIQFAHGEEDLKVQHSSYRQRARLLKDQLSLGIAALQITDVKLQDAGVYRCMISYGGADYKRITVKVNA

SEQ ID NO: 1193 - protein, 114 aa, Artificial Sequence
  PD-L1 IgV v63
FTVTVPKDLYVVEYGSNMIIECKFPVGKQLDLAALIVYWEMEDKIIIQFAHGEEDLKVQHSSYRQRARLLKDQLSLGIAALQITDVKLQDAGVYRCKISYGGADYKRITVKVNA

SEQ ID NO: 1194 - protein, 114 aa, Artificial Sequence
  PD-L1 IgV v64
FTVTVPKDLYVVEYGSNMTLECKFPVEKQLDLAALIVYWEKEGKDIIQFVHGEEDLKVQHSSYRQRARLLKDQLSLGNAALQITDVKLQDAGVYRCMISYGGADYKRITVKVNA

SEQ ID NO: 1195 - protein, 114 aa, Artificial Sequence
  PD-L1 IgV v65
FTVTVPKDLYVVEYGSNMTIECRFPVEKQLDLAALIVYWEMEDKTIIQFVHGEEDLKVQHSSYRQRARLLKDQLSLGIAALQITDVKLQDAGVYRCMISYGGADYKRITVKVNA

SEQ ID NO: 1196 - protein, 114 aa, Homo sapiens
  MISC_FEATURE: PD-L1 IgV wildtype
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNA

SEQ ID NO: 1197 - protein, 98 aa, Artificial Sequence
  PD-L2 IgV
FTVTVPKELYIIEHGSNVTLECNFDTGSHVNLGAITASLQKVENDTSPHRERATLLEEQLPLGKASFHIPQVQVRDEGQYQCIIIYGVAWDYKYLTLK

SEQ ID NO: 1198 - protein, 201 aa, Artificial Sequence
  PD-L2 ECD v1
LFTVTVPKELYIIEQGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1199 - protein, 201 aa, Artificial Sequence
  PD-L2 ECD v2
LFTVTVPKELYIIEHGSNVTLECDFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1200 - protein, 201 aa, Artificial Sequence
  PD-L2 ECD v3
LFTVTVPKELYIIEHGSNVTLECNFDTGSHVNLGAITASLQKVDNDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1201 - protein, 201 aa, Artificial Sequence
  PD-L2 ECD v4
LFTVTVPKELYIIEHGSNVTLECNFDTGSHVNLGAITASLQKVENDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1202 - protein, 201 aa, Artificial Sequence
  PD-L2 ECD v5
LFTVTVPKELYIIEHGSNVTLECNFDTGSHVNLGAITASLQKVENDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1203 - protein, 201 aa, Artificial Sequence
  PD-L2 ECD v6
LFTVTVPKELYIIEHGSNVTLECNFDTGSHVNLGAITASLQKVENDTSPHRERATLLEGQLPLGKASFHIPQVQVRDEGQYRCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1204 - protein, 201 aa, Artificial Sequence
  PD-L2 ECD v7
LFTVTVPKELYIIEHGSNVTLECNFDTGSHVNLGAITAILQKVENDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1205 - protein, 201 aa, Artificial Sequence
  PD-L2 ECD v8
LFTVTVPKELYIIEHGSNVTLECNFDTGSHVNLGAITASLQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1206 - protein, 201 aa, Artificial Sequence
  PD-L2 ECD v9
LFTVTVPKELYIIEHGSNVTLECNFDTGSHVNLGAITASLQKVENDTSPHRERATLLEEQLPLGKALFHIPQVQVRDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1207 - protein, 201 aa, Artificial Sequence
  PD-L2 ECD v10
LFTVTVPKELYIIEHGSNVTLECNFDTGSHVNLGAITASLQKVENDTSPHRERATLLEEQLPLGKALFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1208 - protein, 201 aa, Artificial Sequence
  PD-L2 ECD v11
LFTVTVPKELYIIEQGSNVTLECNFDTGSHVNLGAITASLQKVENDTSPHRERATLLEEQLPLGRASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1209 - protein, 201 aa, Artificial Sequence
  PD-L2 ECD v12
LFTVTVPKELYIIEQGSNVTLECNFDTGSHVNLGAITASLQKVENDTSPHRERATLLEEQLPLGKASFHIPHVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1210 - protein, 201 aa, Artificial Sequence
  PD-L2 ECD v13
LFTVTVPKELYIIEQGSNVTLECNFDTGSHVNLGAITASLQKVENDTSPHRERATLLEEQLPLGKALFHIPQVQVGDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1211 - protein, 201 aa, Artificial Sequence
  PD-L2 ECD v14
LFTVTVPKELYIIEQGSNVTLECNFDTGSHVNLGAITASLQKVENDTSPHRERATLLEEQLPLGKASFHIPQVQVGDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1212 - protein, 201 aa, Artificial Sequence
  PD-L2 ECD v15
LFTVTVPKELYIIEQGSNVTLECNFDTGSHVNLGAITASLQKVENDASPHRERATLLEEQLPLGKASFHIPQVQVRDEGQYRCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1213 - protein, 201 aa, Artificial Sequence
  PD-L2 ECD v16
LFTVTVPKELYIIEQGSNVTLECNFDTGSHVNLGAITASLQKVENDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1214 - protein, 201 aa, Artificial Sequence
  PD-L2 ECD v17
LFTVTVPKELYIIEQGSNVTLESNFDTGSHVNLGAITASLQKVENDTSPHRERATLLEEQLPLGKASFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1215 - protein, 201 aa, Artificial Sequence
  PD-L2 ECD v18
LFTVTVPKELYIIEQGSNVTLECNFDTGSHVNLGAITAILQKVENDTSPHRERATLLEEQLPLGKASFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1216 - protein, 201 aa, Artificial Sequence; identical to SEQ ID NO: 1211
  PD-L2 ECD v19

SEQ ID NO: 1217 - protein, 201 aa, Artificial Sequence
  PD-L2 ECD v20
LFTVTVPKELYIIEHGSNVTLECNFDTGSHVNLGAITASLQKVDNDTSPHRERATLLEEQLPLGKASFHIPQVQVRDEGQYQCIIIYGDARDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1218 - protein, 201 aa, Artificial Sequence
  PD-L2 ECD v21
LFTVTVPKELYIVEHGSNVTLECNFDTGSHVNLGAITASLQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1219 - protein, 201 aa, Artificial Sequence
  PD-L2 ECD v22
LFTVTVPKELYIIEQGSNVTLECNFDTGSHVNLGAITASLQKVENDTSPHRERATLLEEQLPLGKALFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1220 - protein, 201 aa, Artificial Sequence
  PD-L2 ECD v23
LFTVTVPKELYIVEQGSNVTLECNFDTGSHVNLGAITASLQKVENDTSPHRERATLLEEQLPLGKALFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1221 - protein, 201 aa, Artificial Sequence
  PD-L2 ECD v24
LFTVTVPKELYIVEQGSNVTLECNFDTGSHVNLGAITASLQKVDNDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1222 - protein, 201 aa, Artificial Sequence
  PD-L2 ECD v25
LFTVTVPKELYIVEHGSNVTLECNFDTGSHVNLGAITAILQKVDNDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1223 - protein, 201 aa, Artificial Sequence
  PD-L2 ECD v26
LFTVTVPKELYIVEHGSNVTLECNFDTGSHVNLGAITASLQKVDNDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1224 - protein, 201 aa, Artificial Sequence
  PD-L2 ECD v27
LFTVTVPKELYIVEHGSNVTLECNFDTGSHVNLGAITASLQKVENDTSPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1225 - protein, 201 aa, Artificial Sequence
  PD-L2 ECD v28
LFTVTVPKELYIVEQGSNVTLECNFDTGSHVNLGAITASLQKVENDTSPHRERATLLEEQLPLGKASFHIPQVQVGDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1226 - protein, 201 aa, Artificial Sequence
  PD-L2 ECD v29
LFTVTVPKELYIIEQGSNVTLECNFDTGSHVNLGAITAILQKVENDTSPHRERATLLEEQLPLGKASFHIPQVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1227 - protein, 201 aa, Artificial Sequence
  PD-L2 ECD v30
LFTVTVPKELYIIEQGSNVTLECNFDTGSHVNLGAITASLQKVENDTSPHRERATLLEEQLPLGKALFHIPQVQVGDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1228 - protein, 201 aa, Artificial Sequence
  PD-L2 ECD v31
LFTVTVPKELYIIEQGSNVTLECNFDTGSHVNLGAITASLQKVENDASPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1229 - protein, 201 aa, Artificial Sequence
  PD-L2 ECD v32
LFTVTVPKELYIIEQGSNVTLECNFDTGSHVNLGAITASLQKVENDASPHRERATLLEEQLPLGKASFHIPHVQVGDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1230 - protein, 201 aa, Artificial Sequence
  PD-L2 ECD v33
LFTVTVPKELYIVEQGSNVTLECNFDTGSHVNLGAITASLQKVENDASPHRERATLLEEQLPLGKASFHIPHVQVGDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1231 - protein, 201 aa, Artificial Sequence
  PD-L2 ECD v34
LFTVTVPKELYIIEQGSNVTLECNFDTGSHVNLGAITASLQKVDNDTSPHRERATLLEEQLPLGKASFHIPQVQVGDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1232 - protein, 201 aa, Artificial Sequence
  PD-L2 ECD v35
LFTVTVPKELYIIEQGSNVTLECNFDTGSHVNLGAITAILQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1233 - protein, 201 aa, Artificial Sequence
  PD-L2 ECD v36
LFTVTVPKELYIIEQGSNVTLECNFDTGSHVDLGAITASLQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1234 - protein, 201 aa, Artificial Sequence
  PD-L2 ECD v37
LFTVTVPKELYIIEHGSNVTLECNFDTGSHVDLGAITASLQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1235 - protein, 201 aa, Artificial Sequence
  PD-L2 ECD v38
LFTVTVPKELYIIEQGSNVTLECNFDTGSHVNLGAITASLQKVENDTSPHRERATLLEEQLPLGKALFHIPHVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1236 - protein, 201 aa, Artificial Sequence
  PD-L2 ECD v39
LFTVTVPKELYIIEQGSNVTLECNFDTGSHVNLGAITASLQKVENDTSPHRERATLLEEQLPLGKASFHIPHVRVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1237 - protein, 201 aa, Artificial Sequence
  PD-L2 ECD v40
LFTVTVPKELYIIEHGSNVTLECNFDTVSHVNLGAITASLQKVENDTSPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1238 - protein, 201 aa, Artificial Sequence
  PD-L2 ECD v41
LFTVTVPKELYIVEQGSNVTLECNFDTGSHVNLGAITAILQKVDNDTSPHRERATLLEEQLPLGKALFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1239 - protein, 201 aa, Artificial Sequence
  PD-L2 ECD v42
LFTVTVPKELYIIEHGSNVTLECNFDTGSHVNLGAITASLQKVDNDTSPHRERATLLEEQLPLGKALFHIPHVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1240 - protein, 201 aa, Artificial Sequence
  PD-L2 ECD v43
LFTVTVPKELYIIEQGSNVTLECNFDTGSHVNLGAITASLQKVENDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1241 - protein, 201 aa, Artificial Sequence
  PD-L2 ECD v44
LFTVTVPKELYIIEQGSNVTLECNFDTGSHVNLGAITASLQKVENDASPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1242 - protein, 201 aa, Artificial Sequence
  PD-L2 ECD v45
LFTVTVPKELYIVEQGSNVTLECNFDTGSHVNLGAITASLQKVENDTSPHRERATLLEEQLPLGKASFHIPQVQVRDEGQYRCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1243 - protein, 201 aa, Artificial Sequence
  PD-L2 ECD v46
LFTVTVPKELYIVEQGSNVTLECNFDTGSHVNLGAITASLQKVENDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1244 - protein, 201 aa, Artificial Sequence
  PD-L2 ECD v47
LFTVTVPKELYIVEHGSNVTLECNFDTGSHVNLGAITASLQKVENDTSPHRERATLLEEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1245 - protein, 201 aa, Artificial Sequence
  PD-L2 ECD v48
LFTVTVPKELYIVEQGSNVTLECNFDTGSHVNLGAITASLQKVENDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1246 - protein, 201 aa, Artificial Sequence
  PD-L2 ECD v49
LFTVTVPKELYIIEQGSNVTLECNFDTGSHMNLGAITASLQKVENDTSPHRERATLLEEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1247 - protein, 201 aa, Artificial Sequence
  PD-L2 ECD v50
LFTVTVPKELYIVEQGSNVTLECNFDTGSHVNLGAITASLQKVENDASPHRERATLLEEQLPLGKASFHIPQVQVRDEGQYRCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1248 - protein, 201 aa, Artificial Sequence
  PD-L2 ECD v51
LFTVTVPKELYIVEQGSNVTLECNFDTGSHANLGAITASLQKVESDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1249 - protein, 201 aa, Artificial Sequence
  PD-L2 ECD v52
  VARIANT (65)..(65): X is unknown
LFTVTVPKELYIVEHGSNVALECNFDTGSHVNLGAITASLQKVENDASPHRERATLLEEQLPLGXASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1250 - protein, 201 aa, Artificial Sequence
  PD-L2 ECD v53
LFTVTVPKELYIIEQGSNVTLECNFDTGSHVNLGAITASLQKVENDASPHRERATLLEEQLPLGKASFLIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1251 - protein, 201 aa, Artificial Sequence
  PD-L2 ECD v54
LFTVTVPKELYIVEQGSNVTLECNFDTGSHVNLGAITASLQKVENDASPHRERATLLEEQLPLGKASFLIPQVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1252 - protein, 201 aa, Artificial Sequence
  PD-L2 ECD v55
LFTVTVPKELYVVEQGSNVTLECNFDTGSHVNLGAITASLQKVENDASPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1253 - protein, 201 aa, Artificial Sequence
  PD-L2 ECD v56
LFTVTVPKELYIVEQGSNVTLECNFDTGSHVNLGAITASLQKVENDTSPHRERATLLEEQLPLGKASFHIPQVQVGNEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1254 - protein, 201 aa, Artificial Sequence
  PD-L2 ECD v57
LFTVTVPKELYIVEQGSNVTLECNFDTGSHVNLGAITASLQKVENDASPHRERATLLEEQLPLGKASFHIPQVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1255 - protein, 201 aa, Artificial Sequence
  PD-L2 ECD v58
LFTVTVPKELYIVEQGSNVTLECNFDTGSHVNLGAITASLQKVENDASPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1256 - protein, 201 aa, Artificial Sequence
  PD-L2 ECD v59
LFTVTVPKELYIVEQGSNVTLECDFDTGSHVNLGAITASLQKVENDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1257 - protein, 102 aa, Homo sapiens
  MISC_FEATURE: PD-L2 IgV wildtype
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKA

SEQ ID NO: 1258 - protein, 201 aa, Artificial Sequence
  PD-L2 ECD v61
LFTVTVPKELYIVEQGSNVTLECNFDTGSHVNLGAVTASLQKVENDASPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1259 - protein, 201 aa, Artificial Sequence
  PD-L2 ECD v62
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1260 - protein, 201 aa, Artificial Sequence
  PD-L2 ECD v63
LFTVTVPKELYIIEQGSNVTLECNFDTGSHVNPGAITASLQKVENDASPHRERATLLEEQLPLGKALFHISQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1261 - protein, 201 aa, Artificial Sequence
  PD-L2 ECD v64
LFTVTVPKELYIVEQGSNVTLECNFDTGSHVNLGAITASLQKVENDTSPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1262 - protein, 201 aa, Artificial Sequence
  PD-L2 ECD v65
LFTVTVPKELYIIEQGSNVTLECNFDTGSHVNLGAITASLQKVENDASPHRERATLLEEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1263 - protein, 201 aa, Artificial Sequence
  PD-L2 ECD v66
LLTVTVPKELYIIEQGSNVTLECNFDTGSHVNLGAITASLQKVENEASPHRERATLLEEQLPLGKASFHIPHVQVGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1264 - protein, 201 aa, Artificial Sequence
  PD-L2 ECD v67
LFTVTVPKELYIVEQGSNVTLECNFDTGSHVNFGAITASLQKVENDASPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1265 - protein, 201 aa, Artificial Sequence
  PD-L2 ECD v68
LFTVTVPKELYIVEQGSNVTLECNFDTGSHVNLGAITASLQKVENDASPHRERATLLGEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1266 - protein, 201 aa, Artificial Sequence
  PD-L2 ECD v69
LFTVTVPKELYIIEQGSNVTLECSFDTGSHVNLGAITASLQKVENDASPHRERATLLEEQLPLGKASFHIPHVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1267 - protein, 201 aa, Artificial Sequence
  PD-L2 ECD v70
LFTVTVPKELYIVEQGSNVTLECNFDTGSHVNLGAITASLQKVVNDASPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1268 - protein, 201 aa, Artificial Sequence
  PD-L2 ECD v71
LFTVTVPKELYIIEQGSDVTLECNFDTGSHVNLGAITASLQKVENDASPHRERATLLEEQLPLGKASFHIPHAQVGDEGQYQCIITYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1269 - protein, 201 aa, Artificial Sequence
  PD-L2 ECD v72
LFTVTVPKELYIVEQGSNVTLECNFDTGSHVNLGAIAASLQKVDNDTCPHRERATLLEEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1270 - protein, 201 aa, Artificial Sequence
  PD-L2 ECD v73
LFTVTVPKELYIIEQGSNVTLECNFDTGSHVNHGAITASLQKVENDTSPHRERATLLEEQLPLGKALFHIPQVQVGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1271 - protein, 201 aa, Artificial Sequence
  PD-L2 ECD v74
LFTVTVPKELYIVEQGSNVTLECNFDTGSHVNLGAITASLQKVENDASPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1272 - protein, 201 aa, Artificial Sequence
  PD-L2 ECD v75
LFTVTVPKELYIIEQGSNVTLECNFDTGSHVNLGAITAILQKVDNDTSPHRERATLLEEQLPLGKASFHIPHVQGGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1273 - protein, 201 aa, Artificial Sequence
  PD-L2 ECD v76
LFTVTVPKELYIIEQGSNVTLECNFDTGSHVNLGAITASLQKVENDASPHRERATLLEEQLPLGKALFHIPQVQVGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1274 - protein, 201 aa, Artificial Sequence
  PD-L2 ECD v77
LFTVTVPKELYIVEQGSNVTLECNFDTGSHVNLGAITASLQKVENDASPHRERATLLEEQLPLGKALFHIPHVQVGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1275 - protein, 98 aa, Artificial Sequence
  PDL-2 IgV v1
FTVTVPKELYIIEQGSNVTLECNFDTGSHVNLGAITASLQKVENDTSPHRERATLLEEQLPLGKASFHIPQVQVRDEGQYQCIIIYGVAWDYKYLTLK

SEQ ID NO: 1276 - protein, 98 aa, Artificial Sequence
  PDL-2 IgV v2
FTVTVPKELYIIEHGSNVTLECDFDTGSHVNLGAITASLQKVENDTSPHRERATLLEEQLPLGKASFHIPQVQVRDEGQYQCIIIYGVAWDYKYLTLK

SEQ ID NO: 1277 - protein, 98 aa, Artificial Sequence
  PDL-2 IgV v3
FTVTVPKELYIIEHGSNVTLECNFDTGSHVNLGAITASLQKVDNDTSPHRERATLLEEQLPLGKASFHIPQVQVRDEGQYQCIIIYGVAWDYKYLTLK

SEQ ID NO: 1278 - protein, 98 aa, Artificial Sequence
  PDL-2 IgV v4
FTVTVPKELYIIEHGSNVTLECNFDTGSHVNLGAITASLQKVENDTSPHRERATLLEEQLPLGKASFHIPQVQVRDEGQYQCIIIYGDAWDYKYLTLK

SEQ ID NO: 1279 - protein, 98 aa, Artificial Sequence
  PDL-2 IgV v5
FTVTVPKELYIIEHGSNVTLECNFDTGSHVNLGAITASLQKVENDTSPHRERATLLEEQLPLGKASFHIPQVQVRDEGQYRCIIIYGDAWDYKYLTLK

SEQ ID NO: 1280 - protein, 98 aa, Artificial Sequence
  PDL-2 IgV v6
FTVTVPKELYIIEHGSNVTLECNFDTGSHVNLGAITASLQKVENDTSPHRERATLLEGQLPLGKASFHIPQVQVRDEGQYRCIIIYGVAWDYKYLTLK

SEQ ID NO: 1281 - protein, 98 aa, Artificial Sequence
  PDL-2 IgV v7
FTVTVPKELYIIEHGSNVTLECNFDTGSHVNLGAITAILQKVENDTSPHRERATLLEEQLPLGKASFHIPQVQVRDEGQYQCIIIYGDAWDYKYLTLK

SEQ ID NO: 1282 - protein, 98 aa, Artificial Sequence
  PDL-2 IgV v8
FTVTVPKELYIIEHGSNVTLECNFDTGSHVNLGAITASLQKVENDTSPHRERATLLEEQLPLGKALFHIPQVQVRDEGQYQCIIIYGDAWDYKYLTLK

SEQ ID NO: 1283 - protein, 98 aa, Artificial Sequence
  PDL-2 IgV v9
FTVTVPKELYIIEHGSNVTLECNFDTGSHVNLGAITASLQKVENDTSPHRERATLLEEQLPLGKALFHIPQVQVRDEGQYQCIFIYGVAWDYKYLTLK

SEQ ID NO: 1284 - protein, 98 aa, Artificial Sequence
  PDL-2 IgV v10
FTVTVPKELYIIEHGSNVTLECNFDTGSHVNLGAITASLQKVENDTSPHRERATLLEEQLPLGKALFHIPQVQVRDEGQYQCIITYGVAWDYKYLTLK

SEQ ID NO: 1285 - protein, 98 aa, Artificial Sequence
  PDL-2 IgV v11
FTVTVPKELYIIEQGSNVTLECNFDTGSHVNLGAITASLQKVENDTSPHRERATLLEEQLPLGRASFHIPQVQVRDEGQYQCIIIYGVAWDYKYLTLK

SEQ ID NO: 1286 - protein, 98 aa, Artificial Sequence
  PDL-2 IgV v12
FTVTVPKELYIIEQGSNVTLECNFDTGSHVNLGAITASLQKVENDTSPHRERATLLEEQLPLGKASFHIPHVQVRDEGQYQCIIIYGDAWDYKYLTLK

SEQ ID NO: 1287 - protein, 98 aa, Artificial Sequence
  PDL-2 IgV v13
FTVTVPKELYIIEQGSNVTLECNFDTGSHVNLGAITASLQKVENDTSPHRERATLLEEQLPLGKALFHIPQVQVGDEGQYQCIIIYGVAWDYKYLTLK

SEQ ID NO: 1288 - protein, 98 aa, Artificial Sequence
  PDL-2 IgV v14
FTVTVPKELYIIEQGSNVTLECNFDTGSHVNLGAITASLQKVENDTSPHRERATLLEEQLPLGKASFHIPQVQVGDEGQYQCIFIYGVAWDYKYLTLK

SEQ ID NO: 1289 - protein, 98 aa, Artificial Sequence
  PDL-2 IgV v15
FTVTVPKELYIIEQGSNVTLECNFDTGSHVNLGAITASLQKVENDASPHRERATLLEEQLPLGKASFHIPQVQVRDEGQYRCIIIYGVAWDYKYLTLK

SEQ ID NO: 1290 - protein, 98 aa, Artificial Sequence
  PDL-2 IgV v16
FTVTVPKELYIIEQGSNVTLECNFDTGSHVNLGAITASLQKVENDTSPHRERATLLEEQLPLGKASFHIPQVQVRDEGQYRCIIIYGDAWDYKYLTLK

SEQ ID NO: 1291 - protein, 98 aa, Artificial Sequence
  PDL-2 IgV v17
FTVTVPKELYIIEQGSNVTLESNFDTGSHVNLGAITASLQKVENDTSPHRERATLLEEQLPLGKASFHIPQVQVRDEGQYQCIITYGVAWDYKYLTLK

SEQ ID NO: 1292 - protein, 98 aa, Artificial Sequence
  PDL-2 IgV v18
FTVTVPKELYIIEQGSNVTLECNFDTGSHVNLGAITAILQKVENDTSPHRERATLLEEQLPLGKASFHIPQVQVRDEGQYQCIITYGVAWDYKYLTLK

SEQ ID NO: 1293 - protein, 98 aa, Artificial Sequence; identical to SEQ ID NO: 1288
  PDL-2 IgV v19

SEQ ID NO: 1294 - protein, 98 aa, Artificial Sequence
  PDL-2 IgV v20
FTVTVPKELYIIEHGSNVTLECNFDTGSHVNLGAITASLQKVDNDTSPHRERATLLEEQLPLGKASFHIPQVQVRDEGQYQCIIIYGDARDYKYLTLK

SEQ ID NO: 1295 - protein, 98 aa, Artificial Sequence
  PDL-2 IgV v21
FTVTVPKELYIVEHGSNVTLECNFDTGSHVNLGAITASLQKVENDTSPHRERATLLEEQLPLGKALFHIPQVQVRDEGQYQCIIIYGDAWDYKYLTLK

SEQ ID NO: 1296 - protein, 98 aa, Artificial Sequence
  PDL-2 IgV v22
FTVTVPKELYIIEQGSNVTLECNFDTGSHVNLGAITASLQKVENDTSPHRERATLLEEQLPLGKALFHIPQVQVRDEGQYQCIITYGVAWDYKYLTLK

SEQ ID NO: 1297 - protein, 98 aa, Artificial Sequence
  PDL-2 IgV v23
FTVTVPKELYIVEQGSNVTLECNFDTGSHVNLGAITASLQKVENDTSPHRERATLLEEQLPLGKALFHIPQVQVRDEGQYQCIITYGVAWDYKYLTLK

SEQ ID NO: 1298 - protein, 98 aa, Artificial Sequence
  PDL-2 IgV v24
FTVTVPKELYIVEQGSNVTLECNFDTGSHVNLGAITASLQKVDNDTSPHRERATLLEEQLPLGKASFHIPQVQVRDEGQYQCIIIYGDAWDYKYLTLK

SEQ ID NO: 1299 - protein, 98 aa, Artificial Sequence
  PDL-2 IgV v25
FTVTVPKELYIVEHGSNVTLECNFDTGSHVNLGAITAILQKVDNDTSPHRERATLLEEQLPLGKASFHIPQVQVRDEGQYRCIIIYGDAWDYKYLTLK

SEQ ID NO: 1300 - protein, 98 aa, Artificial Sequence
  PDL-2 IgV v26
FTVTVPKELYIVEHGSNVTLECNFDTGSHVNLGAITASLQKVDNDTSPHRERATLLEEQLPLGKASFHIPQVQVRDEGQYRCIIIYGDAWDYKYLTLK

SEQ ID NO: 1301 - protein, 98 aa, Artificial Sequence
  PDL-2 IgV v27
FTVTVPKELYIVEHGSNVTLECNFDTGSHVNLGAITASLQKVENDTSPHRERATLLEEQLPLGKASFHIPHVQVGDEGQYQCIITYGVAWDYKYLTLK

SEQ ID NO: 1302 - protein, 98 aa, Artificial Sequence
  PDL-2 IgV v28
FTVTVPKELYIVEQGSNVTLECNFDTGSHVNLGAITASLQKVENDTSPHRERATLLEEQLPLGKASFHIPQVQVGDEGQYQCIFIYGVAWDYKYLTLK

SEQ ID NO: 1303 - protein, 98 aa, Artificial Sequence
  PDL-2 IgV v29
FTVTVPKELYIIEQGSNVTLECNFDTGSHVNLGAITAILQKVENDTSPHRERATLLEEQLPLGKASFHIPQVQVGDEGQYQCIIIYGDAWDYKYLTLK

SEQ ID NO: 1304 - protein, 98 aa, Artificial Sequence
  PDL-2 IgV v30
FTVTVPKELYIIEQGSNVTLECNFDTGSHVNLGAITASLQKVENDTSPHRERATLLEEQLPLGKALFHIPQVQVGDEGQYQCIFIYGVAWDYKYLTLK

SEQ ID NO: 1305 - protein, 98 aa, Artificial Sequence
  PDL-2 IgV v31
FTVTVPKELYIIEQGSNVTLECNFDTGSHVNLGAITASLQKVENDASPHRERATLLEEQLPLGKASFHIPHVQVGDEGQYQCIITYGVAWDYKYLTLK

SEQ ID NO: 1306 - protein, 98 aa, Artificial Sequence
  PDL-2 IgV v32
FTVTVPKELYIIEQGSNVTLECNFDTGSHVNLGAITASLQKVENDASPHRERATLLEEQLPLGKASFHIPHVQVGDEGQYQCIIIYGVAWDYKYLTLK

SEQ ID NO: 1307 - protein, 98 aa, Artificial Sequence
  PDL-2 IgV v33
FTVTVPKELYIVEQGSNVTLECNFDTGSHVNLGAITASLQKVENDASPHRERATLLEEQLPLGKASFHIPHVQVGDEGQYQCIIIYGVAWDYKYLTLK

SEQ ID NO: 1308 - protein, 98 aa, Artificial Sequence
  PDL-2 IgV v34
FTVTVPKELYIIEQGSNVTLECNFDTGSHVNLGAITASLQKVDNDTSPHRERATLLEEQLPLGKASFHIPQVQVGDEGQYQCIFIYGVAWDYKYLTLK

SEQ ID NO: 1309 - protein, 98 aa, Artificial Sequence
  PDL-2 IgV v35
FTVTVPKELYIIEQGSNVTLECNFDTGSHVNLGAITAILQKVENDTSPHRERATLLEEQLPLGKALFHIPQVQVRDEGQYQCIIIYGDAWDYKYLTLK

SEQ ID NO: 1310 - protein, 98 aa, Artificial Sequence
  PDL-2 IgV v36
FTVTVPKELYIIEQGSNVTLECNFDTGSHVDLGAITASLQKVENDTSPHRERATLLEEQLPLGKALFHIPQVQVRDEGQYQCIIIYGDAWDYKYLTLK

SEQ ID NO: 1311 - protein, 98 aa, Artificial Sequence
  PDL-2 IgV v37
FTVTVPKELYIIEHGSNVTLECNFDTGSHVDLGAITASLQKVENDTSPHRERATLLEEQLPLGKALFHIPQVQVRDEGQYQCIIIYGDAWDYKYLTLK

SEQ ID NO: 1312 - protein, 98 aa, Artificial Sequence
  PDL-2 IgV v38
FTVTVPKELYIIEQGSNVTLECNFDTGSHVNLGAITASLQKVENDTSPHRERATLLEEQLPLGKALFHIPHVQVGDEGQYQCIIIYGDAWDYKYLTLK

SEQ ID NO: 1313 - protein, 98 aa, Artificial Sequence
  PDL-2 IgV v39
FTVTVPKELYIIEQGSNVTLECNFDTGSHVNLGAITASLQKVENDTSPHRERATLLEEQLPLGKASFHIPHVRVGDEGQYQCIITYGVAWDYKYLTLK

SEQ ID NO: 1314 - protein, 98 aa, Artificial Sequence
  PDL-2 IgV v40
FTVTVPKELYIIEHGSNVTLECNFDTVSHVNLGAITASLQKVENDTSPHRERATLLEEQLPLGKASFHIPHVQVGDEGQYQCIITYGVAWDYKYLTLK

SEQ ID NO: 1315 - protein, 98 aa, Artificial Sequence
  PDL-2 IgV v41
FTVTVPKELYIVEQGSNVTLECNFDTGSHVNLGAITAILQKVDNDTSPHRERATLLEEQLPLGKALFHIPQVQVRDEGQYQCIIIYGVAWDYKYLTLK

SEQ ID NO: 1316 - protein, 98 aa, Artificial Sequence
  PDL-2 IgV v42
FTVTVPKELYIIEHGSNVTLECNFDTGSHVNLGAITASLQKVDNDTSPHRERATLLEEQLPLGKALFHIPHVQVRDEGQYRCIIIYGDAWDYKYLTLK

SEQ ID NO: 1317 - protein, 98 aa, Artificial Sequence
  PDL-2 IgV v43
FTVTVPKELYIIEQGSNVTLECNFDTGSHVNLGAITASLQKVENDTSPHRERATLLEEQLPLGKASFHIPQVQVRDEGQYQCIIIYGDAWDYKYLTLK

SEQ ID NO: 1318 - protein, 98 aa, Artificial Sequence
  PDL-2 IgV v44
FTVTVPKELYIIEQGSNVTLECNFDTGSHVNLGAITASLQKVENDASPHRERATLLEEQLPLGKASFHIPQVQVRDEGQYQCIIIYGVAWDYKYLTLK

SEQ ID NO: 1319 - protein, 98 aa, Artificial Sequence
  PDL-2 IgV v45
FTVTVPKELYIVEQGSNVTLECNFDTGSHVNLGAITASLQKVENDTSPHRERATLLEEQLPLGKASFHIPQVQVRDEGQYRCIIIYGVAWDYKYLTLK

SEQ ID NO: 1320 - protein, 98 aa, Artificial Sequence
  PDL-2 IgV v46
FTVTVPKELYIVEQGSNVTLECNFDTGSHVNLGAITASLQKVENDTSPHRERATLLEEQLPLGKASFHIPQVQVRDEGQYQCIIIYGDAWDYKYLTLK

SEQ ID NO: 1321 - protein, 98 aa, Artificial Sequence
  PDL-2 IgV v47
FTVTVPKELYIVEHGSNVTLECNFDTGSHVNLGAITASLQKVENDTSPHRERATLLEEQLPLGKALFHIPQVQVRDEGQYRCIIIYGDAWDYKYLTLK

SEQ ID NO: 1322 - protein, 98 aa, Artificial Sequence
  PDL-2 IgV v48
FTVTVPKELYIVEQGSNVTLECNFDTGSHVNLGAITASLQKVENDTSPHRERATLLEEQLPLGKASFHIPQVQVRDEGQYRCIIIYGDAWDYKYLTLK

SEQ ID NO: 1323 - protein, 98 aa, Artificial Sequence
  PDL-2 IgV v49
FTVTVPKELYIIEQGSNVTLECNFDTGSHMNLGAITASLQKVENDTSPHRERATLLEEQLPLGKALFHIPQVQVRDEGQYRCIIIYGDAWDYKYLTLK

SEQ ID NO: 1324 - protein, 98 aa, Artificial Sequence
  PDL-2 IgV v50
FTVTVPKELYIVEQGSNVTLECNFDTGSHVNLGAITASLQKVENDASPHRERATLLEEQLPLGKASFHIPQVQVRDEGQYRCIIIYGVAWDYKYLTLK

SEQ ID NO: 1325 - protein, 98 aa, Artificial Sequence
  PDL-2 IgV v51
FTVTVPKELYIVEQGSNVTLECNFDTGSHANLGAITASLQKVESDTSPHRERATLLEEQLPLGKASFHIPQVQVRDEGQYRCIIIYGDAWDYKYLTLK

SEQ ID NO: 1326 - protein, 98 aa, Artificial Sequence
  PDL-2 IgV v52
  VARIANT (64)..(64): X is unknown
FTVTVPKELYIVEHGSNVALECNFDTGSHVNLGAITASLQKVENDASPHRERATLLEEQLPLGXASFHIPQVQVRDEGQYRCIIIYGDAWDYKYLTLK

SEQ ID NO: 1327 - protein, 98 aa, Artificial Sequence
  PDL-2 IgV v53
FTVTVPKELYIIEQGSNVTLECNFDTGSHVNLGAITASLQKVENDASPHRERATLLEEQLPLGKASFLIPQVQVRDEGQYRCIIIYGDAWDYKYLTLK

SEQ ID NO: 1328 - protein, 98 aa, Artificial Sequence
  PDL-2 IgV v54
FTVTVPKELYIVEQGSNVTLECNFDTGSHVNLGAITASLQKVENDASPHRERATLLEEQLPLGKASFLIPQVQVGDEGQYQCIIIYGDAWDYKYLTLK

SEQ ID NO: 1329 - protein, 98 aa, Artificial Sequence
  PDL-2 IgV v55
FTVTVPKELYVVEQGSNVTLECNFDTGSHVNLGAITASLQKVENDASPHRERATLLEEQLPLGKASFHIPQVQVRDEGQYRCIIIYGDAWDYKYLTLK

SEQ ID NO: 1330 - protein, 98 aa, Artificial Sequence
  PDL-2 IgV v56
FTVTVPKELYIVEQGSNVTLECNFDTGSHVNLGAITASLQKVENDTSPHRERATLLEEQLPLGKASFHIPQVQVGNEGQYRCIIIYGDAWDYKYLTLK

SEQ ID NO: 1331 - protein, 98 aa, Artificial Sequence
  PDL-2 IgV v57
FTVTVPKELYIVEQGSNVTLECNFDTGSHVNLGAITASLQKVENDASPHRERATLLEEQLPLGKASFHIPQVQVGDEGQYQCIIIYGDAWDYKYLTLK

SEQ ID NO: 1332 - protein, 98 aa, Artificial Sequence
  PDL-2 IgV v58
FTVTVPKELYIVEQGSNVTLECNFDTGSHVNLGAITASLQKVENDASPHRERATLLEEQLPLGKASFHIPQVQVRDEGQYRCIIIYGDAWDYKYLTLK

SEQ ID NO: 1333 - protein, 98 aa, Artificial Sequence
  PDL-2 IgV v60
FTVTVPKELYIVEQGSNVTLECDFDTGSHVNLGAITASLQKVENDTSPHRERATLLEEQLPLGKASFHIPQVQVRDEGQYRCIIIYGDAWDYKYLTLK

SEQ ID NO: 1334 - protein, 98 aa, Artificial Sequence
  PDL-2 IgV v61
FTVTVPKELYIVEQGSNVTLECNFDTGSHVNLGAVTASLQKVENDASPHRERATLLEEQLPLGKALFHIPQVQVRDEGQYQCIIIYGDAWDYKYLTLK

SEQ ID NO: 1335 - protein, 98 aa, Artificial Sequence
  PDL-2 IgV v62
FTVTVPKELYIIEQGSNVTLECNFDTGSHVNLGAITASLQKVENDASPHRERATLLEEQLPLGRALFHIPQVQVRDEGQYRCIIIYGDAWDYKYLTLK

SEQ ID NO: 1336 - protein, 98 aa, Artificial Sequence
  PDL-2 IgV v63
FTVTVPKELYIIEQGSNVTLECNFDTGSHVNPGAITASLQKVENDASPHRERATLLEEQLPLGKALFHISQVQVRDEGQYQCIIIYGDAWDYKYLTLK

SEQ ID NO: 1337 - protein, 98 aa, Artificial Sequence
  PDL-2 IgV v64
FTVTVPKELYIVEQGSNVTLECNFDTGSHVNLGAITASLQKVENDTSPHRERATLLEEQLPLGKASFHIPHVQVGDEGQYQCIITYGVAWDYKYLTLK

SEQ ID NO: 1338 - protein, 98 aa, Artificial Sequence
  PDL-2 IgV v65
FTVTVPKELYIIEQGSNVTLECNFDTGSHVNLGAITASLQKVENDASPHRERATLLEEQLPLGKALFHIPQVQVRDEGQYRCIIIYGDAWDYKYLTLK

SEQ ID NO: 1339 - protein, 98 aa, Artificial Sequence
  PDL-2 IgV v66
LTVTVPKELYIIEQGSNVTLECNFDTGSHVNLGAITASLQKVENEASPHRERATLLEEQLPLGKASFHIPHVQVGDEGQYRCIIIYGDAWDYKYLTLK

SEQ ID NO: 1340 - protein, 98 aa, Artificial Sequence
  PDL-2 IgV v67
FTVTVPKELYIVEQGSNVTLECNFDTGSHVNFGAITASLQKVENDASPHRERATLLEEQLPLGKASFHIPQVQVRDEGQYRCIIIYGDAWDYKYLTLK

SEQ ID NO: 1341 - protein, 98 aa, Artificial Sequence
  PDL-2 IgV v68
FTVTVPKELYIVEQGSNVTLECNFDTGSHVNLGAITASLQKVENDASPHRERATLLGEQLPLGKALFHIPQVQVRDEGQYRCIIIYGDAWDYKYLTLK

SEQ ID NO: 1342 - protein, 98 aa, Artificial Sequence
  PDL-2 IgV v69
FTVTVPKELYIIEQGSNVTLECSFDTGSHVNLGAITASLQKVENDASPHRERATLLEEQLPLGKASFHIPHVQVGDEGQYQCIIIYGDAWDYKYLTLK

SEQ ID NO: 1343 - protein, 98 aa, Artificial Sequence
  PDL-2 IgV v70
FTVTVPKELYIVEQGSNVTLECNFDTGSHVNLGAITASLQKVVNDASPHRERATLLEEQLPLGKASFHIPQVQVRDEGQYRCIIIYGDAWDYKYLTLK

SEQ ID NO: 1344 - protein, 98 aa, Artificial Sequence
  PDL-2 IgV v71
FTVTVPKELYIIEQGSDVTLECNFDTGSHVNLGAITASLQKVENDASPHRERATLLEEQLPLGKASFHIPHAQVGDEGQYQCIITYGDAWDYKYLTLK

SEQ ID NO: 1345 - protein, 98 aa, Artificial Sequence
  PDL-2 IgV v72
FTVTVPKELYIVEQGSNVTLECNFDTGSHVNLGAIAASLQKVDNDTCPHRERATLLEEQLPLGKALFHIPQVQVRDEGQYRCIIIYGDAWDYKYLTLK

SEQ ID NO: 1346 - protein, 98 aa, Artificial Sequence
  PDL-2 IgV v73
FTVTVPKELYIIEQGSNVTLECNFDTGSHVNHGAITASLQKVENDTSPHRERATLLEEQLPLGKALFHIPQVQVGDEGQYRCIIIYGDAWDYKYLTLK

SEQ ID NO: 1347 - protein, 98 aa, Artificial Sequence
  PDL-2 IgV v74
FTVTVPKELYIVEQGSNVTLECNFDTGSHVNLGAITASLQKVENDASPHRERATLLEEQLPLGKASFHIPHVQVGDEGQYQCIITYGVAWDYKYLTLK

SEQ ID NO: 1348 - protein, 98 aa, Artificial Sequence
  PDL-2 IgV v75
FTVTVPKELYIIEQGSNVTLECNFDTGSHVNLGAITAILQKVDNDTSPHRERATLLEEQLPLGKASFHIPHVQGGDEGQYRCIIIYGDAWDYKYLTLK

SEQ ID NO: 1349 - protein, 98 aa, Artificial Sequence
  PDL-2 IgV v76
FTVTVPKELYIIEQGSNVTLECNFDTGSHVNLGAITASLQKVENDASPHRERATLLEEQLPLGKALFHIPQVQVGDEGQYRCIIIYGDAWDYKYLTLK

SEQ ID NO: 1350 - protein, 98 aa, Artificial Sequence
  PDL-2 IgV v77
FTVTVPKELYIVEQGSNVTLECNFDTGSHVNLGAITASLQKVENDASPHRERATLLEEQLPLGKALFHIPHVQVGDEGQYRCIIIYGDAWDYKYLTLK

SEQ ID NO: 1351 - protein, 102 aa, Artificial Sequence
  PDL-2 IgV v1
LFTVTVPKELYIIEQGSNVTLECNFDTGSHVNLGAITASLQKVENDTSPHRERATLLEEQLPLGKASFHIPQVQVRDEGQYQCIIIYGVAWDYKYLTLKVKA

SEQ ID NO: 1352 - protein, 102 aa, Artificial Sequence
  PDL-2 IgV v2
LFTVTVPKELYIIEHGSNVTLECDFDTGSHVNLGAITASLQKVENDTSPHRERATLLEEQLPLGKASFHIPQVQVRDEGQYQCIIIYGVAWDYKYLTLKVKA

SEQ ID NO: 1353 - protein, 102 aa, Artificial Sequence
  PDL-2 IgV v3
LFTVTVPKELYIIEHGSNVTLECNFDTGSHVNLGAITASLQKVDNDTSPHRERATLLEEQLPLGKASFHIPQVQVRDEGQYQCIIIYGVAWDYKYLTLKVKA

SEQ ID NO: 1354 - protein, 102 aa, Artificial Sequence
  PDL-2 IgV v4
LFTVTVPKELYIIEHGSNVTLECNFDTGSHVNLGAITASLQKVENDTSPHRERATLLEEQLPLGKASFHIPQVQVRDEGQYQCIIIYGDAWDYKYLTLKVKA

SEQ ID NO: 1355 - protein, 102 aa, Artificial Sequence
  PDL-2 IgV v5
LFTVTVPKELYIIEHGSNVTLECNFDTGSHVNLGAITASLQKVENDTSPHRERATLLEEQLPLGKASFHIPQVQVRDEGQYRCIIIYGDAWDYKYLTLKVKA

SEQ ID NO: 1356 - protein, 102 aa, Artificial Sequence
  PDL-2 IgV v6
LFTVTVPKELYIIEHGSNVTLECNFDTGSHVNLGAITASLQKVENDTSPHRERATLLEGQLPLGKASFHIPQVQVRDEGQYRCIIIYGVAWDYKYLTLKVKA

SEQ ID NO: 1357 - protein, 102 aa, Artificial Sequence
  PDL-2 IgV v7
LFTVTVPKELYIIEHGSNVTLECNFDTGSHVNLGAITAILQKVENDTSPHRERATLLEEQLPLGKASFHIPQVQVRDEGQYQCIIIYGDAWDYKYLTLKVKA

SEQ ID NO: 1358 - protein, 102 aa, Artificial Sequence
  PDL-2 IgV v8
LFTVTVPKELYIIEHGSNVTLECNFDTGSHVNLGAITASLQKVENDTSPHRERATLLEEQLPLGKALFHIPQVQVRDEGQYQCIIIYGDAWDYKYLTLKVKA

SEQ ID NO: 1359 - protein, 102 aa, Artificial Sequence
  PDL-2 IgV v9
LFTVTVPKELYIIEHGSNVTLECNFDTGSHVNLGAITASLQKVENDTSPHRERATLLEEQLPLGKALFHIPQVQVRDEGQYQCIFIYGVAWDYKYLTLKVKA

SEQ ID NO: 1360 - protein, 102 aa, Artificial Sequence
  PDL-2 IgV v10
LFTVTVPKELYIIEHGSNVTLECNFDTGSHVNLGAITASLQKVENDTSPHRERATLLEEQLPLGKALFHIPQVQVRDEGQYQCIITYGVAWDYKYLTLKVKA

SEQ ID NO: 1361 - protein, 102 aa, Artificial Sequence
  PDL-2 IgV v11
LFTVTVPKELYIIEQGSNVTLECNFDTGSHVNLGAITASLQKVENDTSPHRERATLLEEQLPLGRASFHIPQVQVRDEGQYQCIIIYGVAWDYKYLTLKVKA

SEQ ID NO: 1362 - protein, 102 aa, Artificial Sequence
  PDL-2 IgV v12
LFTVTVPKELYIIEQGSNVTLECNFDTGSHVNLGAITASLQKVENDTSPHRERATLLEEQLPLGKASFHIPHVQVRDEGQYQCIIIYGDAWDYKYLTLKVKA

SEQ ID NO: 1363 - protein, 102 aa, Artificial Sequence
  PDL-2 IgV v13
LFTVTVPKELYIIEQGSNVTLECNFDTGSHVNLGAITASLQKVENDTSPHRERATLLEEQLPLGKALFHIPQVQVGDEGQYQCIIIYGVAWDYKYLTLKVKA

SEQ ID NO: 1364 - protein, 102 aa, Artificial Sequence
  PDL-2 IgV v14
LFTVTVPKELYIIEQGSNVTLECNFDTGSHVNLGAITASLQKVENDTSPHRERATLLEEQLPLGKASFHIPQVQVGDEGQYQCIFIYGVAWDYKYLTLKVKA

SEQ ID NO: 1365 - protein, 102 aa, Artificial Sequence
  PDL-2 IgV v15
LFTVTVPKELYIIEQGSNVTLECNFDTGSHVNLGAITASLQKVENDASPHRERATLLEEQLPLGKASFHIPQVQVRDEGQYRCIIIYGVAWDYKYLTLKVKA

SEQ ID NO: 1366 - protein, 102 aa, Artificial Sequence
  PDL-2 IgV v16
LFTVTVPKELYIIEQGSNVTLECNFDTGSHVNLGAITASLQKVENDTSPHRERATLLEEQLPLGKASFHIPQVQVRDEGQYRCIIIYGDAWDYKYLTLKVKA

SEQ ID NO: 1367 - protein, 102 aa, Artificial Sequence
  PDL-2 IgV v17
LFTVTVPKELYIIEQGSNVTLESNFDTGSHVNLGAITASLQKVENDTSPHRERATLLEEQLPLGKASFHIPQVQVRDEGQYQCIITYGVAWDYKYLTLKVKA

SEQ ID NO: 1368 - protein, 102 aa, Artificial Sequence
  PDL-2 IgV v18
LFTVTVPKELYIIEQGSNVTLECNFDTGSHVNLGAITAILQKVENDTSPHRERATLLEEQLPLGKASFHIPQVQVRDEGQYQCIITYGVAWDYKYLTLKVKA

SEQ ID NO: 1369 - protein, 102 aa, Artificial Sequence; identical to SEQ ID NO: 1364
  PDL-2 IgV v19

SEQ ID NO: 1370 - protein, 102 aa, Artificial Sequence
  PDL-2 IgV v20
LFTVTVPKELYIIEHGSNVTLECNFDTGSHVNLGAITASLQKVDNDTSPHRERATLLEEQLPLGKASFHIPQVQVRDEGQYQCIIIYGDARDYKYLTLKVKA

SEQ ID NO: 1371 - protein, 102 aa, Artificial Sequence
  PDL-2 IgV v21
LFTVTVPKELYIVEHGSNVTLECNFDTGSHVNLGAITASLQKVENDTSPHRERATLLEEQLPLGKALFHIPQVQVRDEGQYQCIIIYGDAWDYKYLTLKVKA

SEQ ID NO: 1372 - protein, 102 aa, Artificial Sequence
  PDL-2 IgV v22
LFTVTVPKELYIIEQGSNVTLECNFDTGSHVNLGAITASLQKVENDTSPHRERATLLEEQLPLGKALFHIPQVQVRDEGQYQCIITYGVAWDYKYLTLKVKA

SEQ ID NO: 1373 - protein, 102 aa, Artificial Sequence
  PDL-2 IgV v23
LFTVTVPKELYIVEQGSNVTLECNFDTGSHVNLGAITASLQKVENDTSPHRERATLLEEQLPLGKALFHIPQVQVRDEGQYQCIITYGVAWDYKYLTLKVKA

SEQ ID NO: 1374 - protein, 102 aa, Artificial Sequence
  PDL-2 IgV v24
LFTVTVPKELYIVEQGSNVTLECNFDTGSHVNLGAITASLQKVDNDTSPHRERATLLEEQLPLGKASFHIPQVQVRDEGQYQCIIIYGDAWDYKYLTLKVKA

SEQ ID NO: 1375 - protein, 102 aa, Artificial Sequence
  PDL-2 IgV v25
LFTVTVPKELYIVEHGSNVTLECNFDTGSHVNLGAITAILQKVDNDTSPHRERATLLEEQLPLGKASFHIPQVQVRDEGQYRCIIIYGDAWDYKYLTLKVKA

SEQ ID NO: 1376 - protein, 102 aa, Artificial Sequence
  PDL-2 IgV v26
LFTVTVPKELYIVEHGSNVTLECNFDTGSHVNLGAITASLQKVDNDTSPHRERATLLEEQLPLGKASFHIPQVQVRDEGQYRCIIIYGDAWDYKYLTLKVKA

SEQ ID NO: 1377 - protein, 102 aa, Artificial Sequence
  PDL-2 IgV v27
LFTVTVPKELYIVEHGSNVTLECNFDTGSHVNLGAITASLQKVENDTSPHRERATLLEEQLPLGKASFHIPHVQVGDEGQYQCIITYGVAWDYKYLTLKVKA

SEQ ID NO: 1378 - protein, 102 aa, Artificial Sequence
  PDL-2 IgV v28
LFTVTVPKELYIVEQGSNVTLECNFDTGSHVNLGAITASLQKVENDTSPHRERATLLEEQLPLGKASFHIPQVQVGDEGQYQCIFIYGVAWDYKYLTLKVKA

SEQ ID NO: 1379 - protein, 102 aa, Artificial Sequence
  PDL-2 IgV v29
LFTVTVPKELYIIEQGSNVTLECNFDTGSHVNLGAITAILQKVENDTSPHRERATLLEEQLPLGKASFHIPQVQVGDEGQYQCIIIYGDAWDYKYLTLKVKA

SEQ ID NO: 1380 - protein, 102 aa, Artificial Sequence
  PDL-2 IgV v30
LFTVTVPKELYIIEQGSNVTLECNFDTGSHVNLGAITASLQKVENDTSPHRERATLLEEQLPLGKALFHIPQVQVGDEGQYQCIFIYGVAWDYKYLTLKVKA

SEQ ID NO: 1381 - protein, 102 aa, Artificial Sequence
  PDL-2 IgV v31
LFTVTVPKELYIIEQGSNVTLECNFDTGSHVNLGAITASLQKVENDASPHRERATLLEEQLPLGKASFHIPHVQVGDEGQYQCIITYGVAWDYKYLTLKVKA

SEQ ID NO: 1382 - protein, 102 aa, Artificial Sequence
  PDL-2 IgV v32
LFTVTVPKELYIIEQGSNVTLECNFDTGSHVNLGAITASLQKVENDASPHRERATLLEEQLPLGKASFHIPHVQVGDEGQYQCIIIYGVAWDYKYLTLKVKA

SEQ ID NO: 1383 - protein, 102 aa, Artificial Sequence
  PDL-2 IgV v33
LFTVTVPKELYIVEQGSNVTLECNFDTGSHVNLGAITASLQKVENDASPHRERATLLEEQLPLGKASFHIPHVQVGDEGQYQCIIIYGVAWDYKYLTLKVKA

SEQ ID NO: 1384 - protein, 102 aa, Artificial Sequence
  PDL-2 IgV v34
LFTVTVPKELYIIEQGSNVTLECNFDTGSHVNLGAITASLQKVDNDTSPHRERATLLEEQLPLGKASFHIPQVQVGDEGQYQCIFIYGVAWDYKYLTLKVKA

SEQ ID NO: 1385 - protein, 102 aa, Artificial Sequence
  PDL-2 IgV v35
LFTVTVPKELYIIEQGSNVTLECNFDTGSHVNLGAITAILQKVENDTSPHRERATLLEEQLPLGKALFHIPQVQVRDEGQYQCIIIYGDAWDYKYLTLKVKA

SEQ ID NO: 1386 - protein, 102 aa, Artificial Sequence
  PDL-2 IgV v36
LFTVTVPKELYIIEQGSNVTLECNFDTGSHVDLGAITASLQKVENDTSPHRERATLLEEQLPLGKALFHIPQVQVRDEGQYQCIIIYGDAWDYKYLTLKVKA

SEQ ID NO: 1387 - protein, 102 aa, Artificial Sequence
  PDL-2 IgV v37
LFTVTVPKELYIIEHGSNVTLECNFDTGSHVDLGAITASLQKVENDTSPHRERATLLEEQLPLGKALFHIPQVQVRDEGQYQCIIIYGDAWDYKYLTLKVKA

SEQ ID NO: 1388 - protein, 102 aa, Artificial Sequence
  PDL-2 IgV v38
LFTVTVPKELYIIEQGSNVTLECNFDTGSHVNLGAITASLQKVENDTSPHRERATLLEEQLPLGKALFHIPHVQVGDEGQYQCIIIYGDAWDYKYLTLKVKA

SEQ ID NO: 1389 - protein, 102 aa, Artificial Sequence
  PDL-2 IgV v39
LFTVTVPKELYIIEQGSNVTLECNFDTGSHVNLGAITASLQKVENDTSPHRERATLLEEQLPLGKASFHIPHVRVGDEGQYQCIITYGVAWDYKYLTLKVKA

SEQ ID NO: 1390 - protein, 102 aa, Artificial Sequence
  PDL-2 IgV v40
LFTVTVPKELYIIEHGSNVTLECNFDTVSHVNLGAITASLQKVENDTSPHRERATLLEEQLPLGKASFHIPHVQVGDEGQYQCIITYGVAWDYKYLTLKVKA

SEQ ID NO: 1391 - protein, 102 aa, Artificial Sequence
  PDL-2 IgV v41
LFTVTVPKELYIVEQGSNVTLECNFDTGSHVNLGAITAILQKVDNDTSPHRERATLLEEQLPLGKALFHIPQVQVRDEGQYQCIIIYGVAWDYKYLTLKVKA

SEQ ID NO: 1392 - protein, 102 aa, Artificial Sequence
  PDL-2 IgV v42
LFTVTVPKELYIIEHGSNVTLECNFDTGSHVNLGAITASLQKVDNDTSPHRERATLLEEQLPLGKALFHIPHVQVRDEGQYRCIIIYGDAWDYKYLTLKVKA

SEQ ID NO: 1393 - protein, 102 aa, Artificial Sequence
  PDL-2 IgV v43
LFTVTVPKELYIIEQGSNVTLECNFDTGSHVNLGAITASLQKVENDTSPHRERATLLEEQLPLGKASFHIPQVQVRDEGQYQCIIIYGDAWDYKYLTLKVKA

SEQ ID NO: 1394 - protein, 102 aa, Artificial Sequence
  PDL-2 IgV v44
LFTVTVPKELYIIEQGSNVTLECNFDTGSHVNLGAITASLQKVENDASPHRERATLLEEQLPLGKASFHIPQVQVRDEGQYQCIIIYGVAWDYKYLTLKVKA

SEQ ID NO: 1395 - protein, 102 aa, Artificial Sequence
  PDL-2 IgV v45
LFTVTVPKELYIVEQGSNVTLECNFDTGSHVNLGAITASLQKVENDTSPHRERATLLEEQLPLGKASFHIPQVQVRDEGQYRCIIIYGVAWDYKYLTLKVKA

SEQ ID NO: 1396 - protein, 102 aa, Artificial Sequence
  PDL-2 IgV v46
LFTVTVPKELYIVEQGSNVTLECNFDTGSHVNLGAITASLQKVENDTSPHRERATLLEEQLPLGKASFHIPQVQVRDEGQYQCIIIYGDAWDYKYLTLKVKA

SEQ ID NO: 1397 - protein, 102 aa, Artificial Sequence
  PDL-2 IgV v47
LFTVTVPKELYIVEHGSNVTLECNFDTGSHVNLGAITASLQKVENDTSPHRERATLLEEQLPLGKALFHIPQVQVRDEGQYRCIIIYGDAWDYKYLTLKVKA

SEQ ID NO: 1398 - protein, 102 aa, Artificial Sequence
  PDL-2 IgV v48
LFTVTVPKELYIVEQGSNVTLECNFDTGSHVNLGAITASLQKVENDTSPHRERATLLEEQLPLGKASFHIPQVQVRDEGQYRCIIIYGDAWDYKYLTLKVKA

SEQ ID NO: 1399 - protein, 102 aa, Artificial Sequence
  PDL-2 IgV v49
LFTVTVPKELYIIEQGSNVTLECNFDTGSHMNLGAITASLQKVENDTSPHRERATLLEEQLPLGKALFHIPQVQVRDEGQYRCIIIYGDAWDYKYLTLKVKA

SEQ ID NO: 1400 - protein, 102 aa, Artificial Sequence
  PDL-2 IgV v50
LFTVTVPKELYIVEQGSNVTLECNFDTGSHVNLGAITASLQKVENDASPHRERATLLEEQLPLGKASFHIPQVQVRDEGQYRCIIIYGVAWDYKYLTLKVKA

SEQ ID NO: 1401 - protein, 102 aa, Artificial Sequence
  PDL-2 IgV v51
LFTVTVPKELYIVEQGSNVTLECNFDTGSHANLGAITASLQKVESDTSPHRERATLLEEQLPLGKASFHIPQVQVRDEGQYRCIIIYGDAWDYKYLTLKVKA

SEQ ID NO: 1402 - protein, 102 aa, Artificial Sequence
  PDL-2 IgV v52
  VARIANT (65)..(65): X is unknown
LFTVTVPKELYIVEHGSNVALECNFDTGSHVNLGAITASLQKVENDASPHRERATLLEEQLPLGXASFHIPQVQVRDEGQYRCIIIYGDAWDYKYLTLKVKA

SEQ ID NO: 1403 - protein, 102 aa, Artificial Sequence
  PDL-2 IgV v53
LFTVTVPKELYIIEQGSNVTLECNFDTGSHVNLGAITASLQKVENDASPHRERATLLEEQLPLGKASFLIPQVQVRDEGQYRCIIIYGDAWDYKYLTLKVKA

SEQ ID NO: 1404 - protein, 102 aa, Artificial Sequence
  PDL-2 IgV v54
LFTVTVPKELYIVEQGSNVTLECNFDTGSHVNLGAITASLQKVENDASPHRERATLLEEQLPLGKASFLIPQVQVGDEGQYQCIIIYGDAWDYKYLTLKVKA

SEQ ID NO: 1405 - protein, 102 aa, Artificial Sequence
  PDL-2 IgV v55
LFTVTVPKELYVVEQGSNVTLECNFDTGSHVNLGAITASLQKVENDASPHRERATLLEEQLPLGKASFHIPQVQVRDEGQYRCIIIYGDAWDYKYLTLKVKA

SEQ ID NO: 1406 - protein, 102 aa, Artificial Sequence
  PDL-2 IgV v56
LFTVTVPKELYIVEQGSNVTLECNFDTGSHVNLGAITASLQKVENDTSPHRERATLLEEQLPLGKASFHIPQVQVGNEGQYRCIIIYGDAWDYKYLTLKVKA

SEQ ID NO: 1407 - protein, 102 aa, Artificial Sequence
  PDL-2 IgV v57
LFTVTVPKELYIVEQGSNVTLECNFDTGSHVNLGAITASLQKVENDASPHRERATLLEEQLPLGKASFHIPQVQVGDEGQYQCIIIYGDAWDYKYLTLKVKA

SEQ ID NO: 1408 - protein, 102 aa, Artificial Sequence
  PDL-2 IgV v58
LFTVTVPKELYIVEQGSNVTLECNFDTGSHVNLGAITASLQKVENDASPHRERATLLEEQLPLGKASFHIPQVQVRDEGQYRCIIIYGDAWDYKYLTLKVKA

SEQ ID NO: 1409 - protein, 102 aa, Artificial Sequence
  PDL-2 IgV v60
LFTVTVPKELYIVEQGSNVTLECDFDTGSHVNLGAITASLQKVENDTSPHRERATLLEEQLPLGKASFHIPQVQVRDEGQYRCIIIYGDAWDYKYLTLKVKA

SEQ ID NO: 1410 - protein, 102 aa, Artificial Sequence
  PDL-2 IgV v61
LFTVTVPKELYIVEQGSNVTLECNFDTGSHVNLGAVTASLQKVENDASPHRERATLLEEQLPLGKALFHIPQVQVRDEGQYQCIIIYGDAWDYKYLTLKVKA

SEQ ID NO: 1411 - protein, 102 aa, Artificial Sequence
  PDL-2 IgV v62
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKA

SEQ ID NO: 1412 - protein, 102 aa, Artificial Sequence
  PDL-2 IgV v63
LFTVTVPKELYIIEQGSNVTLECNFDTGSHVNPGAITASLQKVENDASPHRERATLLEEQLPLGKALFHISQVQVRDEGQYQCIIIYGDAWDYKYLTLKVKA

SEQ ID NO: 1413 - protein, 102 aa, Artificial Sequence
  PDL-2 IgV v64
LFTVTVPKELYIVEQGSNVTLECNFDTGSHVNLGAITASLQKVENDTSPHRERATLLEEQLPLGKASFHIPHVQVGDEGQYQCIITYGVAWDYKYLTLKVKA

SEQ ID NO: 1414 - protein, 102 aa, Artificial Sequence
  PDL-2 IgV v65
LFTVTVPKELYIIEQGSNVTLECNFDTGSHVNLGAITASLQKVENDASPHRERATLLEEQLPLGKALFHIPQVQVRDEGQYRCIIIYGDAWDYKYLTLKVKA

SEQ ID NO: 1415 - protein, 102 aa, Artificial Sequence
  PDL-2 IgV v66
LLTVTVPKELYIIEQGSNVTLECNFDTGSHVNLGAITASLQKVENEASPHRERATLLEEQLPLGKASFHIPHVQVGDEGQYRCIIIYGDAWDYKYLTLKVKA

SEQ ID NO: 1416 - protein, 102 aa, Artificial Sequence
  PDL-2 IgV v67
LFTVTVPKELYIVEQGSNVTLECNFDTGSHVNFGAITASLQKVENDASPHRERATLLEEQLPLGKASFHIPQVQVRDEGQYRCIIIYGDAWDYKYLTLKVKA

SEQ ID NO: 1417 - protein, 102 aa, Artificial Sequence
  PDL-2 IgV v68
LFTVTVPKELYIVEQGSNVTLECNFDTGSHVNLGAITASLQKVENDASPHRERATLLGEQLPLGKALFHIPQVQVRDEGQYRCIIIYGDAWDYKYLTLKVKA

SEQ ID NO: 1418 - protein, 102 aa, Artificial Sequence
  PDL-2 IgV v69
LFTVTVPKELYIIEQGSNVTLECSFDTGSHVNLGAITASLQKVENDASPHRERATLLEEQLPLGKASFHIPHVQVGDEGQYQCIIIYGDAWDYKYLTLKVKA

SEQ ID NO: 1419 - protein, 102 aa, Artificial Sequence
  PDL-2 IgV v70
LFTVTVPKELYIVEQGSNVTLECNFDTGSHVNLGAITASLQKVVNDASPHRERATLLEEQLPLGKASFHIPQVQVRDEGQYRCIIIYGDAWDYKYLTLKVKA

SEQ ID NO: 1420 - protein, 102 aa, Artificial Sequence
  PDL-2 IgV v71
LFTVTVPKELYIIEQGSDVTLECNFDTGSHVNLGAITASLQKVENDASPHRERATLLEEQLPLGKASFHIPHAQVGDEGQYQCIITYGDAWDYKYLTLKVKA

SEQ ID NO: 1421 - protein, 102 aa, Artificial Sequence
  PDL-2 IgV v72
LFTVTVPKELYIVEQGSNVTLECNFDTGSHVNLGAIAASLQKVDNDTCPHRERATLLEEQLPLGKALFHIPQVQVRDEGQYRCIIIYGDAWDYKYLTLKVKA

SEQ ID NO: 1422 - protein, 102 aa, Artificial Sequence
  PDL-2 IgV v73
LFTVTVPKELYIIEQGSNVTLECNFDTGSHVNHGAITASLQKVENDTSPHRERATLLEEQLPLGKALFHIPQVQVGDEGQYRCIIIYGDAWDYKYLTLKVKA

SEQ ID NO: 1423 - protein, 102 aa, Artificial Sequence
  PDL-2 IgV v74
LFTVTVPKELYIVEQGSNVTLECNFDTGSHVNLGAITASLQKVENDASPHRERATLLEEQLPLGKASFHIPHVQVGDEGQYQCIITYGVAWDYKYLTLKVKA

SEQ ID NO: 1424 - protein, 102 aa, Artificial Sequence
  PDL-2 IgV v75
LFTVTVPKELYIIEQGSNVTLECNFDTGSHVNLGAITAILQKVDNDTSPHRERATLLEEQLPLGKASFHIPHVQGGDEGQYRCIIIYGDAWDYKYLTLKVKA

SEQ ID NO: 1425 - protein, 102 aa, Artificial Sequence
  PDL-2 IgV v76
LFTVTVPKELYIIEQGSNVTLECNFDTGSHVNLGAITASLQKVENDASPHRERATLLEEQLPLGKALFHIPQVQVGDEGQYRCIIIYGDAWDYKYLTLKVKA

SEQ ID NO: 1426 - protein, 105 aa, Artificial Sequence
  PDL-2 IgV v77
SEQLFTVTVPKELYIVEQGSNVTLECNFDTGSHVNLGAITASLQKVENDASPHRERATLLEEQLPLGKALFHIPHVQVGDEGQYRCIIIYGDAWDYKYLTLKVKA

SEQ ID NO: 1427 - protein, 229 aa, Artificial Sequence
  IgG4 Fc
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1428 - protein, 229 aa, Artificial Sequence
  IgG4 Fc S228P
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1429 - protein, 232 aa, Artificial Sequence
  IgG1 Fc C220S
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1430 - protein, 329 aa, Artificial sequence
  CD112 v89 ECD
QDVRVQVLPEVRGQLGGTVELPCHLLPPVPGLHISLVTWQRPDAPANHQNVAAFHPKMGPSFPSPKPGSERLSFVSAKQSTGKDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1431 - protein, 329 aa, Artificial sequence
  CD112 v90 ECD
QDVRVQVLPEVRGQLGGTVELPCHLLPPMPGLHISLVTWQRPDAPANHQNVAAFHPKMGPSFPSPKPGSERLSFVSAKQSTGQDTEAELQDATLALHGLTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1432 - protein, 329 aa, Artificial sequence
  CD112 v91 ECD
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1433 - protein, 329 aa, Artificial sequence
  CD112 v92 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1434 - protein, 329 aa, Artificial sequence
  CD112 v93 ECD
QDVRVQVLPEVRGQLGGTVELPCHLLPPVPGLHISLVTWQRPDAPAKHQNVAAFHPKMGPSFPSPKPGSERLSLVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1435 - protein, 329 aa, Artificial sequence
  CD112 v94 ECD
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1436 - protein, 329 aa, Artificial sequence
  CD112 v95 ECD
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTAEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1437 - protein, 329 aa, Artificial sequence
  CD112 v96 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1438 - protein, 329 aa, Artificial sequence
  CD112 v97 ECD
QDVRVQVLPEVRGQLGGTVELPCHLLPPVPGLYISLVTWQRPDAPANHQNVAAFHPKMGPSFPSPKPGSERLSFVPAKQSIGQDTEAELQDATLALHGLTMEDEGYYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1439 - protein, 329 aa, Artificial sequence
  CD112 v98 ECD
QDVRVQVLREVRGQLGGTVEVLCHLLPPVPGLYMSLVTWQRPDAPANHQNVAAFHPKMGPSFPSPKPGFERLSLVSAKQSTGQDTEVELQDATLALHGLTVEDEGNYTCEFVTFPKGSVRGMTWARVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1440 - protein, 329 aa, Artificial sequence
  CD112 v99 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1441 - protein, 329 aa, Artificial sequence
  CD112 v100 ECD
QDVRVQVLPEVRGQLGGTVELPCHLLPPAPGPYISLVTWQRPDAPANHQNVAAFHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1442 - protein, 329 aa, Artificial sequence
  CD112 v101 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGIYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1443 - protein, 329 aa, Artificial sequence
  CD112 v102 ECD
QDVRVQVLPEVWGQLGGTVELPCHLLPPVPGLHISLVTWQRPDAPAKHQNVAAFHPKMGPSFPSPKPGSERLSFVSAKRSTGQDTEAELQDATLALHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1444 - protein, 329 aa, Artificial sequence
  CD112 v103 ECD
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1445 - protein, 329 aa, Artificial sequence
  CD112 v104 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTLPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1446 - protein, 329 aa, Artificial sequence
  CD112 v105 ECD
QDVRVQVLPEVRGQLGGTVELPCHLLPPVPGLHISLVAWQRPDAPTNHQNVAAFHPKMGPSFPSPKPGSERLSFVSAKQSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1447 - protein, 329 aa, Artificial sequence
  CD112 v106 ECD
QDVRVQVLPEVRGQLGGTVELPCHLLPSVPGLHISLVTWQRPDAPANHQNVAAFHPKMGPSFPSPKPGPERLSFVSAKQSTGQDTEAELQDATLALHGLTVEDEGIYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1448 - protein, 329 aa, Artificial sequence
  CD112 v107 ECD
QDVRVQVLPEVRGQLGGTVELPCHLLPPVPGLHISLVTWQRLDAPAKHQNVAAFHPKMGPSFPSPKPGSERLSFVSAKQSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1449 - protein, 329 aa, Artificial sequence
  CD112 v108 ECD
QDVRVQVLPEVRGQLGGTVELPCHLLPPVPGLHISLVTWQRPDAPAKHQNVAAFHPKMGPSFPSPKPGSERLSSVSAKQSTGKDTEAELQDATLALHGLTVEDEGIYTCELVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1450 - protein, 329 aa, Artificial sequence
  CD112 v109 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTARGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1451 - protein, 329 aa, Artificial sequence
  CD112 v100 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1452 - protein, 329 aa, Artificial sequence
  CD112 v111 ECD
QDVRVQVLPEVRGQLGGTVELPCHLLPPVPGLHISLVTWQRPDAPANHQNVAAFHPKMGPSFPSPMPGSERLSFVSAKQSTGQDTEAELQDATLALHGLTVEDEGNYTCEFATFPKGFVRGMTLLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1453 - protein, 329 aa, Artificial sequence
  CD112 v112 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1454 - protein, 125 aa, Artificial sequence
  CD112 v89 IgV
QDVRVQVLPEVRGQLGGTVELPCHLLPPVPGLHISLVTWQRPDAPANHQNVAAFHPKMGPSFPSPKPGSERLSFVSAKQSTGKDTEAELQDATLALHGLTVEDEGNYTCEFVTFPKGTVRGMTWL

SEQ ID NO: 1455 - protein, 125 aa, Artificial sequence
  CD112 v90 IgV
QDVRVQVLPEVRGQLGGTVELPCHLLPPMPGLHISLVTWQRPDAPANHQNVAAFHPKMGPSFPSPKPGSERLSFVSAKQSTGQDTEAELQDATLALHGLTVEDEGIYTCEFATFPKGFVRGMTWL

SEQ ID NO: 1456 - protein, 125 aa, Artificial sequence
  CD112 v91 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGSVRGMTWL

SEQ ID NO: 1457 - protein, 125 aa, Artificial sequence
  CD112 v92 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFATFPKGFVRGMTWL

SEQ ID NO: 1458 - protein, 125 aa, Artificial sequence
  CD112 v93 IgV
QDVRVQVLPEVRGQLGGTVELPCHLLPPVPGLHISLVTWQRPDAPAKHQNVAAFHPKMGPSFPSPKPGSERLSLVSAKQSTGQDTEAELQDATLALHGLTVEDEGNYTCEFATFPKGFVRGMTWL

SEQ ID NO: 1459 - protein, 125 aa, Artificial sequence
  CD112 v94 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWL

SEQ ID NO: 1460 - protein, 125 aa, Artificial sequence
  CD112 v95 IgV
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTAEDEGIYTCEFATFPKGYVRGMTWL

SEQ ID NO: 1461 - protein, 125 aa, Artificial sequence
  CD112 v96 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGTVRGMTWL

SEQ ID NO: 1462 - protein, 125 aa, Artificial sequence
  CD112 v97 IgV
QDVRVQVLPEVRGQLGGTVELPCHLLPPVPGLYISLVTWQRPDAPANHQNVAAFHPKMGPSFPSPKPGSERLSFVPAKQSIGQDTEAELQDATLALHGLTMEDEGYYTCEFVTFPKGFVRGMTWL

SEQ ID NO: 1463 - protein, 125 aa, Artificial sequence
  CD112 v98 IgV
QDVRVQVLREVRGQLGGTVEVLCHLLPPVPGLYMSLVTWQRPDAPANHQNVAAFHPKMGPSFPSPKPGFERLSLVSAKQSTGQDTEVELQDATLALHGLTVEDEGNYTCEFVTFPKGSVRGMTWA

SEQ ID NO: 1464 - protein, 125 aa, Artificial sequence
  CD112 v99 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGNYTCEFVTFPKGSVRGMTWL

SEQ ID NO: 1465 - protein, 125 aa, Artificial sequence
  CD112 v100 IgV
QDVRVQVLPEVRGQLGGTVELPCHLLPPAPGPYISLVTWQRPDAPANHQNVAAFHPKMGPSFPSPKPGSERLSFVSAKQSTGQDTEAELQDATLALHGLTVEDEGNYTCEFATFPKGFVRGMTWL

SEQ ID NO: 1466 - protein, 125 aa, Artificial sequence
  CD112 v101 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGIYTCEFVTFPKGSVRGMTWL

SEQ ID NO: 1467 - protein, 125 aa, Artificial sequence
  CD112 v102 IgV
QDVRVQVLPEVWGQLGGTVELPCHLLPPVPGLHISLVTWQRPDAPAKHQNVAAFHPKMGPSFPSPKPGSERLSFVSAKRSTGQDTEAELQDATLALHGLTVEDEGNYTCEFATFPKGYVRGMTWL

SEQ ID NO: 1468 - protein, 125 aa, Artificial sequence
  CD112 v103 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGTVRGMTWL

SEQ ID NO: 1469 - protein, 125 aa, Artificial sequence
  CD112 v104 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTLPKGTVRGMTWL

SEQ ID NO: 1470 - protein, 125 aa, Artificial sequence
  CD112 v105 IgV
QDVRVQVLPEVRGQLGGTVELPCHLLPPVPGLHISLVAWQRPDAPTNHQNVAAFHPKMGPSFPSPKPGSERLSFVSAKQSTGQDTEAELQDATLALHGLTMEDEGNYTCEFVTFPKGSVRGMTWL

SEQ ID NO: 1471 - protein, 125 aa, Artificial sequence
  CD112 v106 IgV
QDVRVQVLPEVRGQLGGTVELPCHLLPSVPGLHISLVTWQRPDAPANHQNVAAFHPKMGPSFPSPKPGPERLSFVSAKQSTGQDTEAELQDATLALHGLTVEDEGIYTCEFVTFPKGYVRGMTWL

SEQ ID NO: 1472 - protein, 125 aa, Artificial sequence
  CD112 v107 IgV
QDVRVQVLPEVRGQLGGTVELPCHLLPPVPGLHISLVTWQRLDAPAKHQNVAAFHPKMGPSFPSPKPGSERLSFVSAKQSTGQDTEAELQDATLALHGLTMEDEGNYTCEFVTFPKGSVRGMTWL

SEQ ID NO: 1473 - protein, 125 aa, Artificial sequence
  CD112 v108 IgV
QDVRVQVLPEVRGQLGGTVELPCHLLPPVPGLHISLVTWQRPDAPAKHQNVAAFHPKMGPSFPSPKPGSERLSSVSAKQSTGKDTEAELQDATLALHGLTVEDEGIYTCELVTFPKGTVRGMTWL

SEQ ID NO: 1474 - protein, 125 aa, Artificial sequence
  CD112 v109 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTARGMTWL

SEQ ID NO: 1475 - protein, 125 aa, Artificial sequence
  CD112 v100 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGFVRGMTWL

SEQ ID NO: 1476 - protein, 125 aa, Artificial sequence
  CD112 v111 IgV
QDVRVQVLPEVRGQLGGTVELPCHLLPPVPGLHISLVTWQRPDAPANHQNVAAFHPKMGPSFPSPMPGSERLSFVSAKQSTGQDTEAELQDATLALHGLTVEDEGNYTCEFATFPKGFVRGMTLL

SEQ ID NO: 1477 - protein, 125 aa, Artificial sequence
  CD112 v112 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFVTFPKGSVRGMTWL

SEQ ID NO: 1478 - protein, 127 aa, Artificial sequence
  CD112 v89 IgV
QDVRVQVLPEVRGQLGGTVELPCHLLPPVPGLHISLVTWQRPDAPANHQNVAAFHPKMGPSFPSPKPGSERLSFVSAKQSTGKDTEAELQDATLALHGLTVEDEGNYTCEFVTFPKGTVRGMTWLRV

SEQ ID NO: 1479 - protein, 127 aa, Artificial sequence
  CD112 v90 IgV
QDVRVQVLPEVRGQLGGTVELPCHLLPPMPGLHISLVTWQRPDAPANHQNVAAFHPKMGPSFPSPKPGSERLSFVSAKQSTGQDTEAELQDATLALHGLTVEDEGIYTCEFATFPKGFVRGMTWLRV

SEQ ID NO: 1480 - protein, 127 aa, Artificial sequence
  CD112 v91 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGSVRGMTWLRV

SEQ ID NO: 1481 - protein, 127 aa, Artificial sequence
  CD112 v92 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFATFPKGFVRGMTWLRV

SEQ ID NO: 1482 - protein, 127 aa, Artificial sequence
  CD112 v93 IgV
QDVRVQVLPEVRGQLGGTVELPCHLLPPVPGLHISLVTWQRPDAPAKHQNVAAFHPKMGPSFPSPKPGSERLSLVSAKQSTGQDTEAELQDATLALHGLTVEDEGNYTCEFATFPKGFVRGMTWLRV

SEQ ID NO: 1483 - protein, 127 aa, Artificial sequence
  CD112 v94 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWLRV

SEQ ID NO: 1484 - protein, 127 aa, Artificial sequence
  CD112 v95 IgV
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTAEDEGIYTCEFATFPKGYVRGMTWLRV

SEQ ID NO: 1485 - protein, 127 aa, Artificial sequence
  CD112 v96 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGTVRGMTWLRV

SEQ ID NO: 1486 - protein, 127 aa, Artificial sequence
  CD112 v97 IgV
QDVRVQVLPEVRGQLGGTVELPCHLLPPVPGLYISLVTWQRPDAPANHQNVAAFHPKMGPSFPSPKPGSERLSFVPAKQSIGQDTEAELQDATLALHGLTMEDEGYYTCEFVTFPKGFVRGMTWLRV

SEQ ID NO: 1487 - protein, 127 aa, Artificial sequence
  CD112 v98 IgV
QDVRVQVLREVRGQLGGTVEVLCHLLPPVPGLYMSLVTWQRPDAPANHQNVAAFHPKMGPSFPSPKPGFERLSLVSAKQSTGQDTEVELQDATLALHGLTVEDEGNYTCEFVTFPKGSVRGMTWARV

SEQ ID NO: 1488 - protein, 127 aa, Artificial sequence
  CD112 v99 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGNYTCEFVTFPKGSVRGMTWLRV

SEQ ID NO: 1489 - protein, 127 aa, Artificial sequence
  CD112 v100 IgV
QDVRVQVLPEVRGQLGGTVELPCHLLPPAPGPYISLVTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 1490 - protein, 127 aa, Artificial sequence
  CD112 v101 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGIYTCEFVTFPKGSVRGMTWLRV

SEQ ID NO: 1491 - protein, 127 aa, Artificial sequence
  CD112 v102 IgV
QDVRVQVLPEVWGQLGGTVELPCHLLPPVPGLHISLVTWQRPDAPAKHQNVAAFHPKMGPSFPSPKPGSERLSFVSAKRSTGQDTEAELQDATLALHGLTVEDEGNYTCEFATFPKGYVRGMTWLRV

SEQ ID NO: 1492 - protein, 127 aa, Artificial sequence
  CD112 v103 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGTVRGMTWLRV

SEQ ID NO: 1493 - protein, 127 aa, Artificial sequence
  CD112 v104 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTLPKGTVRGMTWLRV

SEQ ID NO: 1494 - protein, 127 aa, Artificial sequence
  CD112 v105 IgV
QDVRVQVLPEVRGQLGGTVELPCHLLPPVPGLHISLVAWQRPDAPTNHQNVAAFHPKMGPSFPSPKPGSERLSFVSAKQSTGQDTEAELQDATLALHGLTMEDEGNYTCEFVTFPKGSVRGMTWLRV

SEQ ID NO: 1495 - protein, 127 aa, Artificial sequence
  CD112 v106 IgV
QDVRVQVLPEVRGQLGGTVELPCHLLPSVPGLHISLVTWQRPDAPANHQNVAAFHPKMGPSFPSPKPGPERLSFVSAKQSTGQDTEAELQDATLALHGLTVEDEGIYTCEFVTFPKGYVRGMTWLRV

SEQ ID NO: 1496 - protein, 127 aa, Artificial sequence
  CD112 v107 IgV
QDVRVQVLPEVRGQLGGTVELPCHLLPPVPGLHISLVTWQRLDAPAKHQNVAAFHPKMGPSFPSPKPGSERLSFVSAKQSTGQDTEAELQDATLALHGLTMEDEGNYTCEFVTFPKGSVRGMTWLRV

SEQ ID NO: 1497 - protein, 127 aa, Artificial sequence
  CD112 v109 IgV
QDVRVQVLPEVRGQLGGTVELPCHLLPPVPGLHISLVTWQRPDAPAKHQNVAAFHPKMGPSFPSPKPGSERLSSVSAKQSTGKDTEAELQDATLALHGLTVEDEGIYTCELVTFPKGTVRGMTWLRV

SEQ ID NO: 1498 - protein, 127 aa, Artificial sequence
  CD112 v109 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTARGMTWLRV

SEQ ID NO: 1499 - protein, 127 aa, Artificial sequence
  CD112 v100 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGFVRGMTWLRV

SEQ ID NO: 1500 - protein, 127 aa, Artificial sequence
  CD112 v111 IgV
QDVRVQVLPEVRGQLGGTVELPCHLLPPVPGLHISLVTWQRPDAPANHQNVAAFHPKMGPSFPSPMPGSERLSFVSAKQSTGQDTEAELQDATLALHGLTVEDEGNYTCEFATFPKGFVRGMTLLRV

SEQ ID NO: 1501 - protein, 127 aa, Artificial sequence
  CD112 v112 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFVTFPKGSVRGMTWLRV

SEQ ID NO: 1502 - protein, 116 aa, Artificial Sequence
  CD155 v120 IgV
PGTGDVVVQAPTQVSGFLGDSVTLPCYLQVPNMEVTHVSQLTWGRHGESGSMAVFHQTQGPSYSESKRLEFVAARPGAELRNASLRMSGLRVEDEGNYTCMFVAFPQGSWSVDIWL

SEQ ID NO: 1503 - protein, 116 aa, Artificial Sequence
  CD155 v121 IgV
PGTGDVVVQAPTQVTGFLGGAVTLPCYLQVPDMEVTHVSQLTWARLGESGSMAVFHQTQGPSYSESKRLEFVAARPGAELRNASLRMSGLRVEDEGNYTCMFVTFPQRSRSVDIWL

SEQ ID NO: 1504 - protein, 116 aa, Artificial Sequence
  CD155 v122 IgV
PGTGDLVVQAPTQVSGFLGDSVTLPCYLQVPNMEVTHVSQLTWARHGESGSMAVFHRTQGPSYSESKRLEFLAARPGAELRNASLKMSGLRVEDEGNYTCEFVTFPQRSRSVDIWL

SEQ ID NO: 1505 - protein, 116 aa, Artificial Sequence
  CD155 v123 IgV
PGTGDVVVQAPTQVSGFLGDSVTLPCYLQVPNMEVTHVSQLTWARRGESGSMAVFHQTQGPSYSESKRLDFVAARPGAELRDASLRMSGLRAEDEGNYTCMFVTFPQRSRSVDIWL

SEQ ID NO: 1506 - protein, 116 aa, Artificial Sequence
  CD155 v124 IgV
PGTGDVVAQAPTQVSGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWL

SEQ ID NO: 1507 - protein, 116 aa, Artificial Sequence
  CD155 v125 IgV
PGTGDVVAQAPTQVSGFLGDSVTLPCYLQVPNMEVTHVSQLTWARHGESGRMAVFHPTKGPSYSESKRLEFVAARPGAELRDASLRMSGLRVEDEGNYTCLFVMFPQGSRSVDIWL

SEQ ID NO: 1508 - protein, 116 aa, Artificial Sequence
  CD155 v126 IgV
PGTGDVVVQAPTQVTGFLGDSVTLPCYLQVPNMEVTHVSQLTWARHGEPGSMAVFHQTQGPAYVESKRLEFVAARPGAELRNASLRMSGLRVEDEGNYTCMFVTFPQRSRSVDIWL

SEQ ID NO: 1509 - protein, 116 aa, Artificial Sequence
  CD155 v127 IgV
PGTGDVVVQAPTQVTGFLGDSVTLPCYLQVPNTEVTHVSQLTWARHGESGSMAVFHQTQGPSYSESKRLEFVAARPGAELRNASLRMSGLRVEDEGNYTCLFVTFPQRSRSVDIWL

SEQ ID NO: 1510 - protein, 116 aa, Artificial Sequence
  CD155 v128 IgV
PGTGGVVVQAPTQVSGFLGDSVTLPCYLQVPNIEATHVSQLTWARQGESGSMAVFHQTQGPSYSESKRLEFVEARLGAELRNASLRMSGLRVEDEGNYTCMFVAFPQGSWSVDIWL

SEQ ID NO: 1511 - protein, 116 aa, Artificial Sequence
  CD155 v129 IgV
PGTGDVVVQAPTQVSGFLGDSVTLPCYLQVPNMEVTHVSQLTWARHGEPGSMAVFHQTQGPAYVESKRLEFVAARPGAELRNASLRMSGLRVEDEGNYTCMFVSFPQGSWSVDIWL

SEQ ID NO: 1512 - protein, 116 aa, Artificial Sequence
  CD155 v130 IgV
PGTGDVVVQAPIQVTGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWL

SEQ ID NO: 1513 - protein, 116 aa, Artificial Sequence
  CD155 v131 IgV
PGTGDVVVQAPTQVFGFLGDSVMLPCYLQVPNMEVTHVSQVTWARHGESGSMAVFHQTKGPSYSESKRLEFVAARPGADLRNASLRMSGLRVEDEGNYTCMFVTFPQDSRSVDIWL

SEQ ID NO: 1514 - protein, 116 aa, Artificial Sequence
  CD155 v132 IgV
PGTGDVVVQAPTQVTGFLGDSVTLPCYLQVPNMGVTHVSQLTWARHGESRSMAVFHQTKGPSYSESKRLEFVAARPGAELRNASLRMSGLRVEDDGNYTCMFVMFPQGSRSVDIWL

SEQ ID NO: 1515 - protein, 116 aa, Artificial Sequence
  CD155 v133 IgV
PGTGDVVVQAPTQVLGFLGDSVTLPCYLQVPNMEVTHVSQLTWARHGESGSMAVFHQTQGPSYSESERLEFVAARPGAELRNASLRMSGLRAEDEGNYTCLFVTFPQRSRSVDIWL

SEQ ID NO: 1516 - protein, 116 aa, Artificial Sequence
  CD155 v134 IgV
PGTGDIVVKAPTQVFGFLGDSVTLPCYLQVPNMEVTHVSQLTWARHGESGSMAVFHQTQGPAYVESKRLEFVAARPGAELRNASLRMFGLRVEDEGNYTCTFVTFPQRIRSVDIWL

SEQ ID NO: 1517 - protein, 116 aa, Artificial Sequence
  CD155 v135 IgV
PGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCMFVTFPQRSRSVDIWL

SEQ ID NO: 1518 - protein, 116 aa, Artificial Sequence
  CD155 v136 IgV
PGTGDIIVQAPTQVSGSLGDSVTLPCYLQVPNMEVTHVSQLAWARHGESGSMAVFHQTQGPSYSESKRLEFVAARPGAELRNASLRMSGLRVEDEGNYTCMFVTYPQRVRSVDIWL

SEQ ID NO: 1519 - protein, 116 aa, Artificial Sequence
  CD155 v137 IgV
PGTGDLVVQAPTQVLGFLGDSVTLPCYLQVPNMEVTHVSQLTWARHGESGSMAVFHQTQGPSYSESKRLEFVAARPGAELRNASLRISGLRVEDEGNYSCMFVTFPQRSRSVDIWL

SEQ ID NO: 1520 - protein, 116 aa, Artificial Sequence
  CD155 v138 IgV
PGTGDVVVQAPTQVCGFLGDSVMLPCYLQVPNMEVTHVSQVTWARHGESGSIAVFHQTKGPSYSESKRLEFVAARPGAELRNASLRMSGLRVEDEGNYTCMFVMFPQGSRSVDIWL

SEQ ID NO: 1521 - protein, 116 aa, Artificial Sequence
  CD155 v139 IgV
PGTGDIVVQAPTQVTGFLGGSVTLPCYLQVPNMEVTHVSQLTWARHGESGSMAVFHQTQGPSYSESKRLEFVAARPGAELRNASLRMSGLRVEDEGNYTCLFVTFPQRSRSVDIWL

SEQ ID NO: 1522 - protein, 116 aa, Artificial Sequence
  CD155 v140 IgV
PGTGDVVVQAPTQVFGFLGDSVTLPCYLQVPNMEVTHVSQLTWARHGESGSMAVFHQTQGPSYSESKRLEFVAARPGAELRNASLRLSGLRAEDEGNYTCMFVTFPQRSRSVDIWL

SEQ ID NO: 1523 - protein, 116 aa, Artificial Sequence
  CD155 v141 IgV
PGTGDVVVQAPTQVTGFLGDSVTLPCYLQVPNTEVTHVSQLTWARHGESGSMAVFHQTQGPAYEESKRLEFVAARQGTELRNASLRMSGLRVEDEGNYTCLFVTFPQRSRSVDIWL

SEQ ID NO: 1524 - protein, 116 aa, Artificial Sequence
  CD155 v142 IgV
PGTGDLVVQAPTQVTGFLGDSVTLPCYLQVPNMEVTHVSQLTWARHGESGSMAVFHQTRGPSYSESKRLEFVAARPGAELRNASLRMSGLRVEDEGNYTCMFVTFPQRSRSVDIWL

SEQ ID NO: 1525 - protein, 122 aa, Artificial Sequence
  CD155 v120 IgV
WPPPGTGDVVVQAPTQVSGFLGDSVTLPCYLQVPNMEVTHVSQLTWGRHGESGSMAVFHQTQGPSYSESKRLEFVAARPGAELRNASLRMSGLRVEDEGNYTCMFVAFPQGSWSVDIWLRVL

SEQ ID NO: 1526 - protein, 122 aa, Artificial Sequence
  CD155 v121 IgV
WPPPGTGDVVVQAPTQVTGFLGGAVTLPCYLQVPDMEVTHVSQLTWARLGESGSMAVFHQTQGPSYSESKRLEFVAARPGAELRNASLRMSGLRVEDEGNYTCMFVTFPQRSRSVDIWLRVL

SEQ ID NO: 1527 - protein, 122 aa, Artificial Sequence
  CD155 v122 IgV
WPPPGTGDLVVQAPTQVSGFLGDSVTLPCYLQVPNMEVTHVSQLTWARHGESGSMAVFHRTQGPSYSESKRLEFLAARPGAELRNASLKMSGLRVEDEGNYTCEFVTFPQRSRSVDIWLRVL

SEQ ID NO: 1528 - protein, 122 aa, Artificial Sequence
  CD155 v123 IgV
WPPPGTGDVVVQAPTQVSGFLGDSVTLPCYLQVPNMEVTHVSQLTWARRGESGSMAVFHQTQGPSYSESKRLDFVAARPGAELRDASLRMSGLRAEDEGNYTCMFVTFPQRSRSVDIWLRVL

SEQ ID NO: 1529 - protein, 122 aa, Artificial Sequence
  CD155 v124 IgV
WPPPGTGDVVAQAPTQVSGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWLRVL

SEQ ID NO: 1530 - protein, 122 aa, Artificial Sequence
  CD155 v125 IgV
WPPPGTGDVVAQAPTQVSGFLGDSVTLPCYLQVPNMEVTHVSQLTWARHGESGRMAVFHPTKGPSYSESKRLEFVAARPGAELRDASLRMSGLRVEDEGNYTCLFVMFPQGSRSVDIWLRVL

SEQ ID NO: 1531 - protein, 122 aa, Artificial Sequence
  CD155 v126 IgV
WPPPGTGDVVVQAPTQVTGFLGDSVTLPCYLQVPNMEVTHVSQLTWARHGEPGSMAVFHQTQGPAYVESKRLEFVAARPGAELRNASLRMSGLRVEDEGNYTCMFVTFPQRSRSVDIWLRVL

SEQ ID NO: 1532 - protein, 122 aa, Artificial Sequence
  CD155 v127 IgV
WPPPGTGDVVVQAPTQVTGFLGDSVTLPCYLQVPNTEVTHVSQLTWARHGESGSMAVFHQTQGPSYSESKRLEFVAARPGAELRNASLRMSGLRVEDEGNYTCLFVTFPQRSRSVDIWLRVL

SEQ ID NO: 1533 - protein, 122 aa, Artificial Sequence
  CD155 v128 IgV
WPPPGTGGVVVQAPTQVSGFLGDSVTLPCYLQVPNIEATHVSQLTWARQGESGSMAVFHQTQGPSYSESKRLEFVEARLGAELRNASLRMSGLRVEDEGNYTCMFVAFPQGSWSVDIWLRVL

SEQ ID NO: 1534 - protein, 122 aa, Artificial Sequence
  CD155 v129 IgV
WPPPGTGDVVVQAPTQVSGFLGDSVTLPCYLQVPNMEVTHVSQLTWARHGEPGSMAVFHQTQGPAYVESKRLEFVAARPGAELRNASLRMSGLRVEDEGNYTCMFVSFPQGSWSVDIWLRVL

SEQ ID NO: 1535 - protein, 122 aa, Artificial Sequence
  CD155 v130 IgV
WPPPGTGDVVVQAPIQVTGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWLRVL

SEQ ID NO: 1536 - protein, 122 aa, Artificial Sequence
  CD155 v131 IgV
WPPPGTGDVVVQAPTQVFGFLGDSVMLPCYLQVPNMEVTHVSQVTWARHGESGSMAVFHQTKGPSYSESKRLEFVAARPGADLRNASLRMSGLRVEDEGNYTCMFVTFPQDSRSVDIWLRVL

SEQ ID NO: 1537 - protein, 122 aa, Artificial Sequence
  CD155 v132 IgV
WPPPGTGDVVVQAPTQVTGFLGDSVTLPCYLQVPNMGVTHVSQLTWARHGESRSMAVFHQTKGPSYSESKRLEFVAARPGAELRNASLRMSGLRVEDDGNYTCMFVMFPQGSRSVDIWLRVL

SEQ ID NO: 1538 - protein, 122 aa, Artificial Sequence
  CD155 v133 IgV
WPPPGTGDVVVQAPTQVLGFLGDSVTLPCYLQVPNMEVTHVSQLTWARHGESGSMAVFHQTQGPSYSESERLEFVAARPGAELRNASLRMSGLRAEDEGNYTCLFVTFPQRSRSVDIWLRVL

SEQ ID NO: 1539 - protein, 122 aa, Artificial Sequence
  CD155 v134 IgV
WPPPGTGDIVVKAPTQVFGFLGDSVTLPCYLQVPNMEVTHVSQLTWARHGESGSMAVFHQTQGPAYVESKRLEFVAARPGAELRNASLRMFGLRVEDEGNYTCTFVTFPQRIRSVDIWLRVL

SEQ ID NO: 1540 - protein, 122 aa, Artificial Sequence
  CD155 v135 IgV
WPPPGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCMFVTFPQRSRSVDIWLRVL

SEQ ID NO: 1541 - protein, 122 aa, Artificial Sequence
  CD155 v136 IgV
WPPPGTGDIIVQAPTQVSGSLGDSVTLPCYLQVPNMEVTHVSQLAWARHGESGSMAVFHQTQGPSYSESKRLEFVAARPGAELRNASLRMSGLRVEDEGNYTCMFVTYPQRVRSVDIWLRVL

SEQ ID NO: 1542 - protein, 122 aa, Artificial Sequence
  CD155 v137 IgV
WPPPGTGDLVVQAPTQVLGFLGDSVTLPCYLQVPNMEVTHVSQLTWARHGESGSMAVFHQTQGPSYSESKRLEFVAARPGAELRNASLRISGLRVEDEGNYSCMFVTFPQRSRSVDIWLRVL

SEQ ID NO: 1543 - protein, 122 aa, Artificial Sequence
  CD155 v138 IgV
WPPPGTGDVVVQAPTQVCGFLGDSVMLPCYLQVPNMEVTHVSQVTWARHGESGSIAVFHQTKGPSYSESKRLEFVAARPGAELRNASLRMSGLRVEDEGNYTCMFVMFPQGSRSVDIWLRVL

SEQ ID NO: 1544 - protein, 122 aa, Artificial Sequence
  CD155 v139 IgV
WPPPGTGDIVVQAPTQVTGFLGGSVTLPCYLQVPNMEVTHVSQLTWARHGESGSMAVFHQTQGPSYSESKRLEFVAARPGAELRNASLRMSGLRVEDEGNYTCLFVTFPQRSRSVDIWLRVL

SEQ ID NO: 1545 - protein, 122 aa, Artificial Sequence
  CD155 v140 IgV
WPPPGTGDVVVQAPTQVFGFLGDSVTLPCYLQVPNMEVTHVSQLTWARHGESGSMAVFHQTQGPSYSESKRLEFVAARPGAELRNASLRLSGLRAEDEGNYTCMFVTFPQRSRSVDIWLRVL

SEQ ID NO: 1546 - protein, 122 aa, Artificial Sequence
  CD155 v141 IgV
WPPPGTGDVVVQAPTQVTGFLGDSVTLPCYLQVPNTEVTHVSQLTWARHGESGSMAVFHQTQGPAYEESKRLEFVAARQGTELRNASLRMSGLRVEDEGNYTCLFVTFPQRSRSVDIWLRVL

SEQ ID NO: 1547 - protein, 122 aa, Artificial Sequence
  CD155 v142 IgV
WPPPGTGDLVVQAPTQVTGFLGDSVTLPCYLQVPNMEVTHVSQLTWARHGESGSMAVFHQTRGPSYSESKRLEFVAARPGAELRNASLRMSGLRVEDEGNYTCMFVTFPQRSRSVDIWLRVL

SEQ ID NO: 1548 - protein, 323 aa, Artificial Sequence
  CD155 v120 ECD
WPPPGTGDVVVQAPTQVSGFLGDSVTLPCYLQVPNMEVTHVSQLTWGRHGESGSMAVFHQTQGPSYSESKRLEFVAARPGAELRNASLRMSGLRVEDEGNYTCMFVAFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1549 - protein, 323 aa, Artificial Sequence
  CD155 v121 ECD
WPPPGTGDVVVQAPTQVTGFLGGAVTLPCYLQVPDMEVTHVSQLTWARLGESGSMAVFHQTQGPSYSESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1550 - protein, 323 aa, Artificial Sequence
  CD155 v122 ECD
WPPPGTGDLVVQAPTQVSGFLGDSVTLPCYLQVPNMEVTHVSQLTWARHGESGSMAVFHRTQGPSYSESKRLEFLAARPGAELRNASLKMSGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1551 - protein, 323 aa, Artificial Sequence
  CD155 v123 ECD
WPPPGTGDVVVQAPTQVSGFLGDSVTLPCYLQVPNMEVTHVSQLTWARRGESGSMAVFHQTQGPSYSESKRLDFVAARPGAELRDASLRMSGLRAEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1552 - protein, 323 aa, Artificial Sequence
  CD155 v124 ECD
WPPPGTGDVVAQAPTQVSGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1553 - protein, 323 aa, Artificial Sequence
  CD155 v125 ECD
WPPPGTGDVVAQAPTQVSGFLGDSVTLPCYLQVPNMEVTHVSQLTWARHGESGRMAVFHPTKGPSYSESKRLEFVAARPGAELRDASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1554 - protein, 323 aa, Artificial Sequence
  CD155 v126 ECD
WPPPGTGDVVVQAPTQVTGFLGDSVTLPCYLQVPNMEVTHVSQLTWARHGEPGSMAVFHQTQGPAYVESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1555 - protein, 323 aa, Artificial Sequence
  CD155 v127 ECD
WPPPGTGDVVVQAPTQVTGFLGDSVTLPCYLQVPNTEVTHVSQLTWARHGESGSMAVFHQTQGPSYSESKRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1556 - protein, 323 aa, Artificial Sequence
  CD155 v128 ECD
WPPPGTGGVVVQAPTQVSGFLGDSVTLPCYLQVPNIEATHVSQLTWARQGESGSMAVFHQTQGPSYSESKRLEFVEARLGAELRNASLRMSGLRVEDEGNYTCMFVAFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1557 - protein, 323 aa, Artificial Sequence
  CD155 v129 ECD
WPPPGTGDVVVQAPTQVSGFLGDSVTLPCYLQVPNMEVTHVSQLTWARHGEPGSMAVFHQTQGPAYVESKRLEFVAARPGAELRNASLRMSGLRVEDEGNYTCMFVSFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1558 - protein, 323 aa, Artificial Sequence
  CD155 v130 ECD
WPPPGTGDVVVQAPIQVTGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1559 - protein, 323 aa, Artificial Sequence
  CD155 v131 ECD
WPPPGTGDVVVQAPTQVFGFLGDSVMLPCYLQVPNMEVTHVSQVTWARHGESGSMAVFHQTKGPSYSESKRLEFVAARPGADLRNASLRMSGLRVEDEGNYTCMFVTFPQDSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1560 - protein, 323 aa, Artificial Sequence
  CD155 v132 ECD
WPPPGTGDVVVQAPTQVTGFLGDSVTLPCYLQVPNMGVTHVSQLTWARHGESRSMAVFHQTKGPSYSESKRLEFVAARPGAELRNASLRMSGLRVEDDGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1561 - protein, 323 aa, Artificial Sequence
  CD155 v133 ECD
WPPPGTGDVVVQAPTQVLGFLGDSVTLPCYLQVPNMEVTHVSQLTWARHGESGSMAVFHQTQGPSYSESERLEFVAARPGAELRNASLRMSGLRAEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1562 - protein, 323 aa, Artificial Sequence
  CD155 v134 ECD
WPPPGTGDIVVKAPTQVFGFLGDSVTLPCYLQVPNMEVTHVSQLTWARHGESGSMAVFHQTQGPAYVESKRLEFVAARPGAELRNASLRMFGLRVEDEGNYTCTFVTFPQRIRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1563 - protein, 323 aa, Artificial Sequence
  CD155 v135 ECD
WPPPGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1564 - protein, 323 aa, Artificial Sequence
  CD155 v136 ECD
WPPPGTGDIIVQAPTQVSGSLGDSVTLPCYLQVPNMEVTHVSQLAWARHGESGSMAVFHQTQGPSYSESKRLEFVAARPGAELRNASLRMSGLRVEDEGNYTCMFVTYPQRVRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1565 - protein, 323 aa, Artificial Sequence
  CD155 v137 ECD
WPPPGTGDLVVQAPTQVLGFLGDSVTLPCYLQVPNMEVTHVSQLTWARHGESGSMAVFHQTQGPSYSESKRLEFVAARPGAELRNASLRISGLRVEDEGNYSCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1566 - protein, 323 aa, Artificial Sequence
  CD155 v138 ECD
WPPPGTGDVVVQAPTQVCGFLGDSVMLPCYLQVPNMEVTHVSQVTWARHGESGSIAVFHQTKGPSYSESKRLEFVAARPGAELRNASLRMSGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1567 - protein, 323 aa, Artificial Sequence
  CD155 v139 ECD
WPPPGTGDIVVQAPTQVTGFLGGSVTLPCYLQVPNMEVTHVSQLTWARHGESGSMAVFHQTQGPSYSESKRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1568 - protein, 323 aa, Artificial Sequence
  CD155 v140 ECD
WPPPGTGDVVVQAPTQVFGFLGDSVTLPCYLQVPNMEVTHVSQLTWARHGESGSMAVFHQTQGPSYSESKRLEFVAARPGAELRNASLRLSGLRAEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1569 - protein, 323 aa, Artificial Sequence
  CD155 v141 ECD
WPPPGTGDVVVQAPTQVTGFLGDSVTLPCYLQVPNTEVTHVSQLTWARHGESGSMAVFHQTQGPAYEESKRLEFVAARQGTELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1570 - protein, 323 aa, Artificial Sequence
  CD155 v142 ECD
WPPPGTGDLVVQAPTQVTGFLGDSVTLPCYLQVPNMEVTHVSQLTWARHGESGSMAVFHQTRGPSYSESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1571 - protein, 323 aa, Artificial Sequence
  CD155 v143 ECD
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1572 - protein, 116 aa, Artificial Sequence
  CD155 v143 IgV
PGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWL

SEQ ID NO: 1573 - protein, 122 aa, Artificial Sequence
  CD155 v143 IgV
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1574 - protein, 323 aa, Artificial Sequence
  CD155 v144 ECD
WPPPGTGDVVVQAPTQVTDFLGDSVTLPCYLQVPNTEVTHVSQLTWARHGESGNMAVFHQTQGPSYSESKRLEFVAARPGAEQRNASLRMSGLRVEDEGNYTCLFVMYPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1575 - protein, 323 aa, Artificial Sequence
  CD155 v145 ECD
WPPPGTGDLVVQAPTQVLGFLGDSVTLPCYLQVPNMEVTHVSQLTWARHGESGSVAVFHQTQGPSYSELKRLEFVAARPGEELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1576 - protein, 323 aa, Artificial Sequence
  CD155 v146 ECD
WPPPGTGDVVVQAPTQVFGFLGDSVTLPCYLQVPNMEVTQVSQLTWARHGESGSMAVFHQKKGPSYSESKRLEFVAARPGAELRNASLRMSGLRVEDEGNYTCMFVVFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1577 - protein, 323 aa, Artificial Sequence
  CD155 v147 ECD
WPPPGTGDVVVQAPTQVSGFLGDSVTLPCYLRVPNMEVTHVSQLTWARHGESGSMAVFHQTKGPSYSESKRLEFVAAGPGAELRNASLRMSGLRVEDEGNYTCLFVAFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1578 - protein, 323 aa, Artificial Sequence
  CD155 v148 ECD
WPPPGTGDVVVHAPTQVTGFSSDSVTLPCYLQVPNMEVTHVSQLTWARHGESGSMAAFHQTRGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1579 - protein, 323 aa, Artificial Sequence
  CD155 v149 ECD
WPPPGTGDIVVQAPTQVSGFLGDPVTLPCYLQVPNMEVTHVSQLTWARQGESGSMAVYHRTKGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1580 - protein, 323 aa, Artificial Sequence
  CD155 v150 ECD
WPPPGTGDVVVQAPTQVTGFLGDSVTLPCYLQVPNMEVTHVSQLTCARRGESGSMAVFHQTQGPAYVESKRLEFVTARPGAELRNATLRMFGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1581 - protein, 323 aa, Artificial Sequence
  CD155 v151 ECD
WPPPGTGDVVVQAPTQVSGFLGDSVTLPCYLQVPNMEVTHVTQLTWARHGGSGSMAVFHQTQGPSYSESKRLEFVAARPGAELRNASLRMSWLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1582 - protein, 323 aa, Artificial Sequence
  CD155 v152 ECD
WPPPGTGDVFVQAPSQVLGFLGDSVTLPCYLQVPNMEVTHVSQLTWAQHGESGSMAVFHQTQGPSYSESKRLEFVAARPGAELRNASLRMSGLRVEDEGNYTCLFVMFPQGSRSMDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1583 - protein, 323 aa, Artificial Sequence
  CD155 v153 ECD
WPPPGTGDVVVQAPTQVSGFMGDSVTLPCFLQVPDMEVTHVSQLTWARHGESGSMAVFHQTQGPSYSESKRLEFVAARLGAELWNASLRMSGLRVEDEGNYTCLFVMFPQGSRSVGIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1584 - protein, 323 aa, Artificial Sequence
  CD155 v154 ECD
WPPPGTGDVVVQAPTQVFGFLGDSVTLPCYLQVPNMEVTHVSQLTWARHGVSGGMAVFHRTQGPSYSESKRLEFVAARQGAGLRNATLRISRLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1585 - protein, 323 aa, Artificial Sequence
  CD155 v155 ECD
WPPPGTGDVVVQAPTHVFGFLGDSVTLPCYLQVPNMEVTHVSQLTWARHGESGSMAVFHQTQGPSYSESKRLEFVAARLGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1586 - protein, 323 aa, Artificial Sequence
  CD155 v156 ECD
WPPPGTGDVVVQAPTQVTGFLGGSVTLPCYLQVPNMEVTHVSQLTWARHGESGSMAVFHRTQGPSYLESKRLEFVAARPGAELRNASLRMSGLRVEDEGNYTCLFVMFPQGSRSADIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1587 - protein, 323 aa, Artificial Sequence
  CD155 v157 ECD
WPPPGTGGIVAQAPTQVTGFLGDSVMLPCYLQVPNMEVTHVSQLTWARHGEPGSMAVFHQTQGPSYSESKRLEFVAARPGAELRNASLRMSALRVEDEGNYTCLFVLFPQGSRSADIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1588 - protein, 323 aa, Artificial Sequence
  CD155 v158 ECD
WPPPGTGDIVVQAPTQVFGFLGDSVTLPCYLQVPNMEVTHVSQLTWERHSESGSMAVFHQTQGPSYSGSKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1589 - protein, 323 aa, Artificial Sequence
  CD155 v159 ECD
WPPPGTGDVVVQAPTQVSGFLGDSVTLPCYLQVPNMEVTHVSQLTWARHGESGSIAVFHQTKGPSYSEPKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1590 - protein, 323 aa, Artificial Sequence
  CD155 v160 ECD
WPPPGTGDVVVQAPTQVTGFLGDSVTLPCYLQVPNMEVSHVSQLTWARHGEPGRMAVFHQTQGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1591 - protein, 323 aa, Artificial Sequence
  CD155 v161 ECD
WPPPGTGDVVVQAPTQVSGFLGNSVTLPCYLQVPNMEVTHVSQLTWARHGESGSMAVFHQTQGPSYSESKRLEFVAARPGAELRNASLRMSGLRVEDEGNYTCLFVMFPQGSRNVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1592 - protein, 323 aa, Artificial Sequence
  CD155 v162 ECD
WPPPGTGDVVVQAPTQVSGFLGDSVTLPCYLQVSNMEVTHVSQLTWARHGVSGSMAVFHQTQGPSYSESKRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1593 - protein, 323 aa, Artificial Sequence
  CD155 v163 ECD
WPPPGTGDVVVQAPTQVSGFLGDSVTLPCYLQVPNMEVTHVSQLTWARHGESGSMAVFNQTQGPSYSESKRLEFAAARPGTELRNASLRMSGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1594 - protein, 323 aa, Artificial Sequence
  CD155 v164 ECD
WPPPGTGDVVVQAPTQVSGFLGDSVTLPCYLQVPNMEVTHVSQLTRARHGESGSMAVFHQTQGPSYSDSKRLEFVAARPGAELRNASLRMSGLRVEDEGNYTCLFVMFPQGSGSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1595 - protein, 323 aa, Artificial Sequence
  CD155 v165 ECD
WPPPGTGDLVVQAPTQVFGFLGDSVTLPCYLQVPNMEVTHVSQLAWARHGESGSMAVFHQTQGPAYVESKRLEFVAAKVGAELRNASLRMSGLRVEDEGNYTCLFVMFPQGSRTVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1596 - protein, 323 aa, Artificial Sequence
  CD155 v166 ECD
WPPPGTGDVVVQAPTQVTGFLGDSVTLPCYLQVPNMEVTHVSQLTWARHGESGSLAVFHQRQGPSYSESKRLEFVAARPGAELRNASLRMSGLRVEDEGNYTCLFIMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1597 - protein, 323 aa, Artificial Sequence
  CD155 v167 ECD
WPPPGTGDVVVQAPIQVSGFLGDSVTLPCYLQMPFMEVSHVSQLTWARHGESGSLAVFHQTQGPSYSESKRLEFVAASPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1598 - protein, 323 aa, Artificial Sequence
  CD155 v168 ECD
WPPPGTGDVVVQAPTQVSGFLGDSVTLPCYLQVPNMEVTHVSQLTWARHGESGSMAVFHQTKGPSYSESERLEFVAARPGAELRNASLRMSELRVEDEGNYTCLFVTFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1599 - protein, 323 aa, Artificial Sequence
  CD155 v169 ECD
WPPPGTGDVVVQAPTQVFGILGDSVMLPCYLQVPNMEVTHVSQLTWVRHGKSGSMAVFHQTQGPSYSESKRLEFVAARPGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1600 - protein, 323 aa, Artificial Sequence
  CD155 v170 ECD
WPPPGTGDVVVQAPTQVTGFLGASVTLPCYLQVPNMEVTHVSQLTWARHGESGSMAVFHHTQGPSYSESKRLEFVAARPGAELRNASLRVSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1601 - protein, 323 aa, Artificial Sequence
  CD155 v171 ECD
WPPPGTGDVVVQAPTQVSGFLGGSVTLPRYLQVPDMGVTHVSQLTWARHGESGSIAVFHQTKGPAYGESKRLEFVAAGPGAELRNASLRMSGLRVEDEGNYTCMFVMFPRGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1602 - protein, 323 aa, Artificial Sequence
  CD155 v172 ECD
WPPPGTGDVVVQEPTQVSGFLGDSVTLPCYLQVPNREVTHVSQLTWARHGESGSMAVFHQTKGPSYTESKRLEFVAARPGAELRDASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1603 - protein, 323 aa, Artificial Sequence
  CD155 v173 ECD
WPPPGTGDIVVQAPTQVTGFLGDSVTLPCYLQVPNMEVTHVSQLTWARRGESGSMAVFHQTQGPSYSESKRLEFVAARPGAELRDASLRMSGLRVEDEGNYTCTFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1604 - protein, 323 aa, Artificial Sequence
  CD155 v174 ECD
WPPPGTGDAVVQAPTQVFGFLGDSVTLPCYLQVPNMEVTHVSQLTWARHGESGSMAVFHQSLGPSYSESKRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1605 - protein, 323 aa, Artificial Sequence
  CD155 v175 ECD
WPPPGTGEVVVQAPTQVTGFLGDSVTLPCYLQVPNMEVTHVSQLTWARHGESGSMAVFHQAQGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1606 - protein, 323 aa, Artificial Sequence
  CD155 v176 ECD
WPPPGTGDVVVQAPTQVSGFLGDSVTLPCYLQVPNMEVTHASQLTWARRGESGCMAVFHQTQGPSYSESKRLEFVAARSGAELRYASPRMSGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1607 - protein, 323 aa, Artificial Sequence
  CD155 v177 ECD
WPPPGTGDVVEQAPTQVHGYLGDSETLPCYLQVPSMEVTHVSQLTWARRGESGSMAVFHQTQGPSYSESKRLEFVAARPGAELRNASLRMSGLRVEDEGNYTCLFVMFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1608 - protein, 323 aa, Artificial Sequence
  CD155 v178 ECD
WPPPGTGDVVAQAPTQVFGFLGASVTLPCYLQVPNMEVTHVSQLTWARHGESGSMAVFHQTQGPSYSESKRLEFVAARPDAELRNASLRMFGLRAEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1609 - protein, 323 aa, Artificial Sequence
  CD155 v179 ECD
WPPPGTGDVVVQAPTQVSGFLGDSVTLPCYLQVPNMEVTHVSQLTWARHGESGSMAVFHQTQGPSYSESRRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1610 - protein, 323 aa, Artificial Sequence
  CD155 v180 ECD
WPPPGTGDLVMQAPTQVSGFLGDSVTLPCYLQVPSMEVTHVSQLTWARHGESGGMAVFHQTKGPSYSESKRLEFVAARPGAELRNASLRMFGLRVEDEGNYTCMFVMFPQGSRSMDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1611 - protein, 323 aa, Artificial Sequence
  CD155 v181 ECD
WPPPGTGDLVVQAPTQVYGFLGDSATLPCYLQVPNMEGTHVSQLTWARHGESGSVAVFHQTQGPSYSESKRLEFVATRPGAELRNASLRISGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1612 - protein, 323 aa, Artificial Sequence
  CD155 v182 ECD
WPPPGTGDVGVQAPTQVTGFLGDSVTLPCYLQVPNMEVTHVSQLTWARHGESGSMAVFHQTQGPSYSESKRQEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1613 - protein, 323 aa, Artificial Sequence
  CD155 v183 ECD
WPPPGTGDVVVQAPTQVSGFLGDSVTLPCYLQVPNMEVTHVSQLTWARHGESGSMAVFRQTQGPSYSESKRLEFVGASPGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1614 - protein, 323 aa, Artificial Sequence
  CD155 v184 ECD
WPPPGTGDAVVQAPTQVSGFLGDSVTLPCYLQVPNTEVTHVSQLTWARHGESGSMAVFHQTQGPGYSESKRLEFVAARPGAELRNASLRMSGLRVEDEGNYTCTFVTFPQRIRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1615 - protein, 323 aa, Artificial Sequence
  CD155 v185 ECD
WPPPGTGDVVVQAPTQVTGFLGDSVTLPCYLQVPNMEVTHVSQLTWARHGEAGSMAAFHRTKGPCYSESKRLEFVAARPGAELRNASLRMTGLRVEDEGYYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1616 - protein, 323 aa, Artificial Sequence
  CD155 v186 ECD
WPPPGTGDVVAQAPTQVFGFLGDSVTLPCYLQVPDMEVTHVSQLTWERHGESGSMAVFHQTKGPSYSESKRLEFVAARPGAELRNASLRMSGLRVEDEDNYTCLFVMFPQGSRNVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1617 - protein, 323 aa, Artificial Sequence
  CD155 v187 ECD
WPPPGTGDVVAQAPTQVTGFLGDSVTLPCYLQVPSMEVTHVSQLTWARHGESGSMAVFHQTQGPSYSESKRLEFVAARPGAELRNATLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1618 - protein, 323 aa, Artificial Sequence
  CD155 v188 ECD
WPPPGTGDDVMLAPTQVSGFLGDSVTLPCYLQVPNMVVTHVSQLTWARHGESGSIAVFHRTQGPSYSESQRLEFVAARPGAELRNASLRMSGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1619 - protein, 323 aa, Artificial Sequence
  CD155 v189 ECD
WPPPGTGDVVVQAPSQVSGFLGDSVTLPCHLLVPNMEVTHVSQLTWARHGESGSMAVFHQTRGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1620 - protein, 116 aa, Artificial Sequence
  CD155 v144 IgV
PGTGDVVVQAPTQVTDFLGDSVTLPCYLQVPNTEVTHVSQLTWARHGESGNMAVFHQTQGPSYSESKRLEFVAARPGAEQRNASLRMSGLRVEDEGNYTCLFVMYPQGSRSVDIWL

SEQ ID NO: 1621 - protein, 116 aa, Artificial Sequence
  CD155 v145 IgV
PGTGDLVVQAPTQVLGFLGDSVTLPCYLQVPNMEVTHVSQLTWARHGESGSVAVFHQTQGPSYSELKRLEFVAARPGEELRNASLRMSGLRVEDEGNYTCLFVMFPQGSRSVDIWL

SEQ ID NO: 1622 - protein, 116 aa, Artificial Sequence
  CD155 v146 IgV
PGTGDVVVQAPTQVFGFLGDSVTLPCYLQVPNMEVTQVSQLTWARHGESGSMAVFHQKKGPSYSESKRLEFVAARPGAELRNASLRMSGLRVEDEGNYTCMFVVFPQGSRSVDIWL

SEQ ID NO: 1623 - protein, 116 aa, Artificial Sequence
  CD155 v147 IgV
PGTGDVVVQAPTQVSGFLGDSVTLPCYLRVPNMEVTHVSQLTWARHGESGSMAVFHQTKGPSYSESKRLEFVAAGPGAELRNASLRMSGLRVEDEGNYTCLFVAFPQGSWSVDIWL

SEQ ID NO: 1624 - protein, 116 aa, Artificial Sequence
  CD155 v148 IgV
PGTGDVVVHAPTQVTGFSSDSVTLPCYLQVPNMEVTHVSQLTWARHGESGSMAAFHQTRGPSYSESKRLEFVAARPGAELRNASLRMSGLRVEDEGNYTCLFVMFPQGSRSVDIWL

SEQ ID NO: 1625 - protein, 116 aa, Artificial Sequence
  CD155 v149 IgV
PGTGDIVVQAPTQVSGFLGDPVTLPCYLQVPNMEVTHVSQLTWARQGESGSMAVYHRTKGPSYSESKRLEFVAARPGAELRNASLRMSGLRVEDEGNYTCLFVMFPQGSRSVDIWL

SEQ ID NO: 1626 - protein, 116 aa, Artificial Sequence
  CD155 v150 IgV
PGTGDVVVQAPTQVTGFLGDSVTLPCYLQVPNMEVTHVSQLTCARRGESGSMAVFHQTQGPAYVESKRLEFVTARPGAELRNATLRMFGLRVEDEGNYTCMFVTFPQGSRSVDIWL

SEQ ID NO: 1627 - protein, 116 aa, Artificial Sequence
  CD155 v151 IgV
PGTGDVVVQAPTQVSGFLGDSVTLPCYLQVPNMEVTHVTQLTWARHGGSGSMAVFHQTQGPSYSESKRLEFVAARPGAELRNASLRMSWLRVEDEGNYTCLFVMFPQGSRSVDIWL

SEQ ID NO: 1628 - protein, 116 aa, Artificial Sequence
  CD155 v152 IgV
PGTGDVFVQAPSQVLGFLGDSVTLPCYLQVPNMEVTHVSQLTWAQHGESGSMAVFHQTQGPSYSESKRLEFVAARPGAELRNASLRMSGLRVEDEGNYTCLFVMFPQGSRSMDIWL

SEQ ID NO: 1629 - protein, 116 aa, Artificial Sequence
  CD155 v153 IgV
PGTGDVVVQAPTQVSGFMGDSVTLPCFLQVPDMEVTHVSQLTWARHGESGSMAVFHQTQGPSYSESKRLEFVAARLGAELWNASLRMSGLRVEDEGNYTCLFVMFPQGSRSVGIWL

SEQ ID NO: 1630 - protein, 116 aa, Artificial Sequence
  CD155 v154 IgV
PGTGDVVVQAPTQVFGFLGDSVTLPCYLQVPNMEVTHVSQLTWARHGVSGGMAVFHRTQGPSYSESKRLEFVAARQGAGLRNATLRISRLRVEDEGNYTCLFVMFPQGSRSVDIWL

SEQ ID NO: 1631 - protein, 116 aa, Artificial Sequence
  CD155 v155 IgV
PGTGDVVVQAPTHVFGFLGDSVTLPCYLQVPNMEVTHVSQLTWARHGESGSMAVFHQTQGPSYSESKRLEFVAARLGAELRNASLRMSGLRVEDEGNYTCLFVMFPQGSRSVDIWL

SEQ ID NO: 1632 - protein, 116 aa, Artificial Sequence
  CD155 v156 IgV
PGTGDVVVQAPTQVTGFLGGSVTLPCYLQVPNMEVTHVSQLTWARHGESGSMAVFHRTQGPSYLESKRLEFVAARPGAELRNASLRMSGLRVEDEGNYTCLFVMFPQGSRSADIWL

SEQ ID NO: 1633 - protein, 116 aa, Artificial Sequence
  CD155 v157 IgV
PGTGGIVAQAPTQVTGFLGDSVMLPCYLQVPNMEVTHVSQLTWARHGEPGSMAVFHQTQGPSYSESKRLEFVAARPGAELRNASLRMSALRVEDEGNYTCLFVLFPQGSRSADIWL

SEQ ID NO: 1634 - protein, 116 aa, Artificial Sequence
  CD155 v158 IgV
PGTGDIVVQAPTQVFGFLGDSVTLPCYLQVPNMEVTHVSQLTWERHSESGSMAVFHQTQGPSYSGSKRLEFVAARPGAELRNASLRMSGLRVEDEGNYTCLFVMFPQGSRSVDIWL

SEQ ID NO: 1635 - protein, 116 aa, Artificial Sequence
  CD155 v159 IgV
PGTGDVVVQAPTQVSGFLGDSVTLPCYLQVPNMEVTHVSQLTWARHGESGSIAVFHQTKGPSYSEPKRLEFVAARPGAELRNASLRMSGLRVEDEGNYTCLFVMFPQGSRSVDIWL

SEQ ID NO: 1636 - protein, 116 aa, Artificial Sequence
  CD155 v160 IgV
PGTGDVVVQAPTQVTGFLGDSVTLPCYLQVPNMEVSHVSQLTWARHGEPGRMAVFHQTQGPSYSESKRLEFVAARPGAELRNASLRMSGLRVEDEGNYTCLFVMFPQGSRSVDIWL

SEQ ID NO: 1637 - protein, 116 aa, Artificial Sequence
  CD155 v161 IgV
PGTGDVVVQAPTQVSGFLGNSVTLPCYLQVPNMEVTHVSQLTWARHGESGSMAVFHQTQGPSYSESKRLEFVAARPGAELRNASLRMSGLRVEDEGNYTCLFVMFPQGSRNVDIWL

SEQ ID NO: 1638 - protein, 116 aa, Artificial Sequence
  CD155 v162 IgV
PGTGDVVVQAPTQVSGFLGDSVTLPCYLQVSNMEVTHVSQLTWARHGVSGSMAVFHQTQGPSYSESKRLEFVAARPGAELRNASLRMSGLRVEDEGNYTCLFVTFPQRSRSVDIWL

SEQ ID NO: 1639 - protein, 116 aa, Artificial Sequence
  CD155 v163 IgV
PGTGDVVVQAPTQVSGFLGDSVTLPCYLQVPNMEVTHVSQLTWARHGESGSMAVFNQTQGPSYSESKRLEFAAARPGTELRNASLRMSGLRVEDEGNYTCMFVMFPQGSRSVDIWL

SEQ ID NO: 1640 - protein, 116 aa, Artificial Sequence
  CD155 v164 IgV
PGTGDVVVQAPTQVSGFLGDSVTLPCYLQVPNMEVTHVSQLTRARHGESGSMAVFHQTQGPSYSDSKRLEFVAARPGAELRNASLRMSGLRVEDEGNYTCLFVMFPQGSGSVDIWL

SEQ ID NO: 1641 - protein, 116 aa, Artificial Sequence
  CD155 v165 IgV
PGTGDLVVQAPTQVFGFLGDSVTLPCYLQVPNMEVTHVSQLAWARHGESGSMAVFHQTQGPAYVESKRLEFVAAKVGAELRNASLRMSGLRVEDEGNYTCLFVMFPQGSRTVDIWL

SEQ ID NO: 1642 - protein, 116 aa, Artificial Sequence
  CD155 v166 IgV
PGTGDVVVQAPTQVTGFLGDSVTLPCYLQVPNMEVTHVSQLTWARHGESGSLAVFHQRQGPSYSESKRLEFVAARPGAELRNASLRMSGLRVEDEGNYTCLFIMFPQGSRSVDIWL

SEQ ID NO: 1643 - protein, 116 aa, Artificial Sequence
  CD155 v167 IgV
PGTGDVVVQAPIQVSGFLGDSVTLPCYLQMPFMEVSHVSQLTWARHGESGSLAVFHQTQGPSYSESKRLEFVAASPGAELRNASLRMSGLRVEDEGNYTCLFVMFPQGSRSVDIWL

SEQ ID NO: 1644 - protein, 116 aa, Artificial Sequence
  CD155 v168 IgV
PGTGDVVVQAPTQVSGFLGDSVTLPCYLQVPNMEVTHVSQLTWARHGESGSMAVFHQTKGPSYSESERLEFVAARPGAELRNASLRMSELRVEDEGNYTCLFVTFPQGSWSVDIWL

SEQ ID NO: 1645 - protein, 116 aa, Artificial Sequence
  CD155 v169 IgV
PGTGDVVVQAPTQVFGILGDSVMLPCYLQVPNMEVTHVSQLTWVRHGKSGSMAVFHQTQGPSYSESKRLEFVAARPGAELRNASLRMSGLRVEDEGNYTCLFVTFPQGSRSVDIWL

SEQ ID NO: 1646 - protein, 116 aa, Artificial Sequence
  CD155 v170 IgV
PGTGDVVVQAPTQVTGFLGASVTLPCYLQVPNMEVTHVSQLTWARHGESGSMAVFHHTQGPSYSESKRLEFVAARPGAELRNASLRVSGLRVEDEGNYTCLFVMFPQGSRSVDIWL

SEQ ID NO: 1647 - protein, 116 aa, Artificial Sequence
  CD155 v171 IgV
PGTGDVVVQAPTQVSGFLGGSVTLPRYLQVPDMGVTHVSQLTWARHGESGSIAVFHQTKGPAYGESKRLEFVAAGPGAELRNASLRMSGLRVEDEGNYTCMFVMFPRGSRSVDIWL

SEQ ID NO: 1648 - protein, 116 aa, Artificial Sequence
  CD155 v172 IgV
PGTGDVVVQEPTQVSGFLGDSVTLPCYLQVPNREVTHVSQLTWARHGESGSMAVFHQTKGPSYTESKRLEFVAARPGAELRDASLRMSGLRVEDEGNYTCLFVMFPQGSRSVDIWL

SEQ ID NO: 1649 - protein, 116 aa, Artificial Sequence
  CD155 v173 IgV
PGTGDIVVQAPTQVTGFLGDSVTLPCYLQVPNMEVTHVSQLTWARRGESGSMAVFHQTQGPSYSESKRLEFVAARPGAELRDASLRMSGLRVEDEGNYTCTFVMFPQGSRSVDIWL

SEQ ID NO: 1650 - protein, 116 aa, Artificial Sequence
  CD155 v174 IgV
PGTGDAVVQAPTQVFGFLGDSVTLPCYLQVPNMEVTHVSQLTWARHGESGSMAVFHQSLGPSYSESKRLEFVAARPGAELRNASLRMSGLRVEDEGNYTCLFVTFPQRSRSVDIWL

SEQ ID NO: 1651 - protein, 116 aa, Artificial Sequence
  CD155 v175 IgV
PGTGEVVVQAPTQVTGFLGDSVTLPCYLQVPNMEVTHVSQLTWARHGESGSMAVFHQAQGPSYSESKRLEFVAARPGAELRNASLRMSGLRVEDEGNYTCLFVMFPQGSRSVDIWL

SEQ ID NO: 1652 - protein, 116 aa, Artificial Sequence
  CD155 v176 IgV
PGTGDVVVQAPTQVSGFLGDSVTLPCYLQVPNMEVTHASQLTWARRGESGCMAVFHQTQGPSYSESKRLEFVAARSGAELRYASPRMSGLRVEDEGNYTCMFVMFPQGSRSVDIWL

SEQ ID NO: 1653 - protein, 116 aa, Artificial Sequence
  CD155 v177 IgV
PGTGDVVEQAPTQVHGYLGDSETLPCYLQVPSMEVTHVSQLTWARRGESGSMAVFHQTQGPSYSESKRLEFVAARPGAELRNASLRMSGLRVEDEGNYTCLFVMFPQRSRSVDIWL

SEQ ID NO: 1654 - protein, 116 aa, Artificial Sequence
  CD155 v178 IgV
PGTGDVVAQAPTQVFGFLGASVTLPCYLQVPNMEVTHVSQLTWARHGESGSMAVFHQTQGPSYSESKRLEFVAARPDAELRNASLRMFGLRAEDEGNYTCLFVMFPQGSRSVDIWL

SEQ ID NO: 1655 - protein, 116 aa, Artificial Sequence
  CD155 v179 IgV
PGTGDVVVQAPTQVSGFLGDSVTLPCYLQVPNMEVTHVSQLTWARHGESGSMAVFHQTQGPSYSESRRLEFVAARPGAELRNASLRMSGLRVEDEGNYTCLFVTFPQRSRSVDIWL

SEQ ID NO: 1656 - protein, 116 aa, Artificial Sequence
  CD155 v180 IgV
PGTGDLVMQAPTQVSGFLGDSVTLPCYLQVPSMEVTHVSQLTWARHGESGGMAVFHQTKGPSYSESKRLEFVAARPGAELRNASLRMFGLRVEDEGNYTCMFVMFPQGSRSMDIWL

SEQ ID NO: 1657 - protein, 116 aa, Artificial Sequence
  CD155 v181 IgV
PGTGDLVVQAPTQVYGFLGDSATLPCYLQVPNMEGTHVSQLTWARHGESGSVAVFHQTQGPSYSESKRLEFVATRPGAELRNASLRISGLRVEDEGNYTCMFVTFPQGSRSVDIWL

SEQ ID NO: 1658 - protein, 116 aa, Artificial Sequence
  CD155 v182 IgV
PGTGDVGVQAPTQVTGFLGDSVTLPCYLQVPNMEVTHVSQLTWARHGESGSMAVFHQTQGPSYSESKRQEFVAARPGAELRNASLRMSGLRVEDEGNYTCLFVMFPQGSRSVDIWL

SEQ ID NO: 1659 - protein, 116 aa, Artificial Sequence
  CD155 v183 IgV
PGTGDVVVQAPTQVSGFLGDSVTLPCYLQVPNMEVTHVSQLTWARHGESGSMAVFRQTQGPSYSESKRLEFVGASPGAELRNASLRMFGLRVEDEGNYTCLFVTFPQGSRSVDIWL

SEQ ID NO: 1660 - protein, 116 aa, Artificial Sequence
  CD155 v184 IgV
PGTGDAVVQAPTQVSGFLGDSVTLPCYLQVPNTEVTHVSQLTWARHGESGSMAVFHQTQGPGYSESKRLEFVAARPGAELRNASLRMSGLRVEDEGNYTCTFVTFPQRIRSVDIWL

SEQ ID NO: 1661 - protein, 116 aa, Artificial Sequence
  CD155 v185 IgV
PGTGDVVVQAPTQVTGFLGDSVTLPCYLQVPNMEVTHVSQLTWARHGEAGSMAAFHRTKGPCYSESKRLEFVAARPGAELRNASLRMTGLRVEDEGYYTCLFVMFPQGSRSVDIWL

SEQ ID NO: 1662 - protein, 116 aa, Artificial Sequence
  CD155 v186 IgV
PGTGDVVAQAPTQVFGFLGDSVTLPCYLQVPDMEVTHVSQLTWERHGESGSMAVFHQTKGPSYSESKRLEFVAARPGAELRNASLRMSGLRVEDEDNYTCLFVMFPQGSRNVDIWL

SEQ ID NO: 1663 - protein, 116 aa, Artificial Sequence
  CD155 v187 IgV
PGTGDVVAQAPTQVTGFLGDSVTLPCYLQVPSMEVTHVSQLTWARHGESGSMAVFHQTQGPSYSESKRLEFVAARPGAELRNATLRMSGLRVEDEGNYTCLFVTFPQGSRSVDIWL

SEQ ID NO: 1664 - protein, 116 aa, Artificial Sequence
  CD155 v188 IgV
PGTGDDVMLAPTQVSGFLGDSVTLPCYLQVPNMVVTHVSQLTWARHGESGSIAVFHRTQGPSYSESQRLEFVAARPGAELRNASLRMSGLRVEDEGNYTCMFVMFPQGSRSVDIWL

SEQ ID NO: 1665 - protein, 116 aa, Artificial Sequence
  CD155 v189 IgV
PGTGDVVVQAPSQVSGFLGDSVTLPCHLLVPNMEVTHVSQLTWARHGESGSMAVFHQTRGPSYSESKRLEFVAARPGAELRNASLRMSGLRVEDEGNYTCLFVMFPQGSRSVDIWL

SEQ ID NO: 1666 - protein, 122 aa, Artificial Sequence
  CD155 v144 IgV
WPPPGTGDVVVQAPTQVTDFLGDSVTLPCYLQVPNTEVTHVSQLTWARHGESGNMAVFHQTQGPSYSESKRLEFVAARPGAEQRNASLRMSGLRVEDEGNYTCLFVMYPQGSRSVDIWLRVL

SEQ ID NO: 1667 - protein, 122 aa, Artificial Sequence
  CD155 v145 IgV
WPPPGTGDLVVQAPTQVLGFLGDSVTLPCYLQVPNMEVTHVSQLTWARHGESGSVAVFHQTQGPSYSELKRLEFVAARPGEELRNASLRMSGLRVEDEGNYTCLFVMFPQGSRSVDIWLRVL

SEQ ID NO: 1668 - protein, 122 aa, Artificial Sequence
  CD155 v146 IgV
WPPPGTGDVVVQAPTQVFGFLGDSVTLPCYLQVPNMEVTQVSQLTWARHGESGSMAVFHQKKGPSYSESKRLEFVAARPGAELRNASLRMSGLRVEDEGNYTCMFVVFPQGSRSVDIWLRVL

SEQ ID NO: 1669 - protein, 122 aa, Artificial Sequence
  CD155 v147 IgV
WPPPGTGDVVVQAPTQVSGFLGDSVTLPCYLRVPNMEVTHVSQLTWARHGESGSMAVFHQTKGPSYSESKRLEFVAAGPGAELRNASLRMSGLRVEDEGNYTCLFVAFPQGSWSVDIWLRVL

SEQ ID NO: 1670 - protein, 122 aa, Artificial Sequence
  CD155 v148 IgV
WPPPGTGDVVVHAPTQVTGFSSDSVTLPCYLQVPNMEVTHVSQLTWARHGESGSMAAFHQTRGPSYSESKRLEFVAARPGAELRNASLRMSGLRVEDEGNYTCLFVMFPQGSRSVDIWLRVL

SEQ ID NO: 1671 - protein, 122 aa, Artificial Sequence
  CD155 v149 IgV
WPPPGTGDIVVQAPTQVSGFLGDPVTLPCYLQVPNMEVTHVSQLTWARQGESGSMAVYHRTKGPSYSESKRLEFVAARPGAELRNASLRMSGLRVEDEGNYTCLFVMFPQGSRSVDIWLRVL

SEQ ID NO: 1672 - protein, 122 aa, Artificial Sequence
  CD155 v150 IgV
WPPPGTGDVVVQAPTQVTGFLGDSVTLPCYLQVPNMEVTHVSQLTCARRGESGSMAVFHQTQGPAYVESKRLEFVTARPGAELRNATLRMFGLRVEDEGNYTCMFVTFPQGSRSVDIWLRVL

SEQ ID NO: 1673 - protein, 122 aa, Artificial Sequence
  CD155 v151 IgV
WPPPGTGDVVVQAPTQVSGFLGDSVTLPCYLQVPNMEVTHVTQLTWARHGGSGSMAVFHQTQGPSYSESKRLEFVAARPGAELRNASLRMSWLRVEDEGNYTCLFVMFPQGSRSVDIWLRVL

SEQ ID NO: 1674 - protein, 122 aa, Artificial Sequence
  CD155 v152 IgV
WPPPGTGDVFVQAPSQVLGFLGDSVTLPCYLQVPNMEVTHVSQLTWAQHGESGSMAVFHQTQGPSYSESKRLEFVAARPGAELRNASLRMSGLRVEDEGNYTCLFVMFPQGSRSMDIWLRVL

SEQ ID NO: 1675 - protein, 122 aa, Artificial Sequence
  CD155 v153 IgV
WPPPGTGDVVVQAPTQVSGFMGDSVTLPCFLQVPDMEVTHVSQLTWARHGESGSMAVFHQTQGPSYSESKRLEFVAARLGAELWNASLRMSGLRVEDEGNYTCLFVMFPQGSRSVGIWLRVL

SEQ ID NO: 1676 - protein, 122 aa, Artificial Sequence
  CD155 v154 IgV
WPPPGTGDVVVQAPTQVFGFLGDSVTLPCYLQVPNMEVTHVSQLTWARHGVSGGMAVFHRTQGPSYSESKRLEFVAARQGAGLRNATLRISRLRVEDEGNYTCLFVMFPQGSRSVDIWLRVL

SEQ ID NO: 1677 - protein, 122 aa, Artificial Sequence
  CD155 v155 IgV
WPPPGTGDVVVQAPTHVFGFLGDSVTLPCYLQVPNMEVTHVSQLTWARHGESGSMAVFHQTQGPSYSESKRLEFVAARLGAELRNASLRMSGLRVEDEGNYTCLFVMFPQGSRSVDIWLRVL

SEQ ID NO: 1678 - protein, 122 aa, Artificial Sequence
  CD155 v156 IgV
WPPPGTGDVVVQAPTQVTGFLGGSVTLPCYLQVPNMEVTHVSQLTWARHGESGSMAVFHRTQGPSYLESKRLEFVAARPGAELRNASLRMSGLRVEDEGNYTCLFVMFPQGSRSADIWLRVL

SEQ ID NO: 1679 - protein, 122 aa, Artificial Sequence
  CD155 v157 IgV
WPPPGTGGIVAQAPTQVTGFLGDSVMLPCYLQVPNMEVTHVSQLTWARHGEPGSMAVFHQTQGPSYSESKRLEFVAARPGAELRNASLRMSALRVEDEGNYTCLFVLFPQGSRSADIWLRVL

SEQ ID NO: 1680 - protein, 122 aa, Artificial Sequence
  CD155 v158 IgV
WPPPGTGDIVVQAPTQVFGFLGDSVTLPCYLQVPNMEVTHVSQLTWERHSESGSMAVFHQTQGPSYSGSKRLEFVAARPGAELRNASLRMSGLRVEDEGNYTCLFVMFPQGSRSVDIWLRVL

SEQ ID NO: 1681 - protein, 122 aa, Artificial Sequence
  CD155 v159 IgV
WPPPGTGDVVVQAPTQVSGFLGDSVTLPCYLQVPNMEVTHVSQLTWARHGESGSIAVFHQTKGPSYSEPKRLEFVAARPGAELRNASLRMSGLRVEDEGNYTCLFVMFPQGSRSVDIWLRVL

SEQ ID NO: 1682 - protein, 122 aa, Artificial Sequence
  CD155 v160 IgV
WPPPGTGDVVVQAPTQVTGFLGDSVTLPCYLQVPNMEVSHVSQLTWARHGEPGRMAVFHQTQGPSYSESKRLEFVAARPGAELRNASLRMSGLRVEDEGNYTCLFVMFPQGSRSVDIWLRVL

SEQ ID NO: 1683 - protein, 122 aa, Artificial Sequence
  CD155 v161 IgV
WPPPGTGDVVVQAPTQVSGFLGNSVTLPCYLQVPNMEVTHVSQLTWARHGESGSMAVFHQTQGPSYSESKRLEFVAARPGAELRNASLRMSGLRVEDEGNYTCLFVMFPQGSRNVDIWLRVL

SEQ ID NO: 1684 - protein, 122 aa, Artificial Sequence
  CD155 v162 IgV
WPPPGTGDVVVQAPTQVSGFLGDSVTLPCYLQVSNMEVTHVSQLTWARHGVSGSMAVFHQTQGPSYSESKRLEFVAARPGAELRNASLRMSGLRVEDEGNYTCLFVTFPQRSRSVDIWLRVL

SEQ ID NO: 1685 - protein, 122 aa, Artificial Sequence
  CD155 v163 IgV
WPPPGTGDVVVQAPTQVSGFLGDSVTLPCYLQVPNMEVTHVSQLTWARHGESGSMAVFNQTQGPSYSESKRLEFAAARPGTELRNASLRMSGLRVEDEGNYTCMFVMFPQGSRSVDIWLRVL

SEQ ID NO: 1686 - protein, 122 aa, Artificial Sequence
  CD155 v164 IgV
WPPPGTGDVVVQAPTQVSGFLGDSVTLPCYLQVPNMEVTHVSQLTRARHGESGSMAVFHQTQGPSYSDSKRLEFVAARPGAELRNASLRMSGLRVEDEGNYTCLFVMFPQGSGSVDIWLRVL

SEQ ID NO: 1687 - protein, 122 aa, Artificial Sequence
  CD155 v165 IgV
WPPPGTGDLVVQAPTQVFGFLGDSVTLPCYLQVPNMEVTHVSQLAWARHGESGSMAVFHQTQGPAYVESKRLEFVAAKVGAELRNASLRMSGLRVEDEGNYTCLFVMFPQGSRTVDIWLRVL

SEQ ID NO: 1688 - protein, 122 aa, Artificial Sequence
  CD155 v166 IgV
WPPPGTGDVVVQAPTQVTGFLGDSVTLPCYLQVPNMEVTHVSQLTWARHGESGSLAVFHQRQGPSYSESKRLEFVAARPGAELRNASLRMSGLRVEDEGNYTCLFIMFPQGSRSVDIWLRVL

SEQ ID NO: 1689 - protein, 122 aa, Artificial Sequence
  CD155 v167 IgV
WPPPGTGDVVVQAPIQVSGFLGDSVTLPCYLQMPFMEVSHVSQLTWARHGESGSLAVFHQTQGPSYSESKRLEFVAASPGAELRNASLRMSGLRVEDEGNYTCLFVMFPQGSRSVDIWLRVL

SEQ ID NO: 1690 - protein, 122 aa, Artificial Sequence
  CD155 v168 IgV
WPPPGTGDVVVQAPTQVSGFLGDSVTLPCYLQVPNMEVTHVSQLTWARHGESGSMAVFHQTKGPSYSESERLEFVAARPGAELRNASLRMSELRVEDEGNYTCLFVTFPQGSWSVDIWLRVL

SEQ ID NO: 1691 - protein, 122 aa, Artificial Sequence
  CD155 v169 IgV
WPPPGTGDVVVQAPTQVFGILGDSVMLPCYLQVPNMEVTHVSQLTWVRHGKSGSMAVFHQTQGPSYSESKRLEFVAARPGAELRNASLRMSGLRVEDEGNYTCLFVTFPQGSRSVDIWLRVL

SEQ ID NO: 1692 - protein, 122 aa, Artificial Sequence
  CD155 v170 IgV
WPPPGTGDVVVQAPTQVTGFLGASVTLPCYLQVPNMEVTHVSQLTWARHGESGSMAVFHHTQGPSYSESKRLEFVAARPGAELRNASLRVSGLRVEDEGNYTCLFVMFPQGSRSVDIWLRVL

SEQ ID NO: 1693 - protein, 122 aa, Artificial Sequence
  CD155 v171 IgV
WPPPGTGDVVVQAPTQVSGFLGGSVTLPRYLQVPDMGVTHVSQLTWARHGESGSIAVFHQTKGPAYGESKRLEFVAAGPGAELRNASLRMSGLRVEDEGNYTCMFVMFPRGSRSVDIWLRVL

SEQ ID NO: 1694 - protein, 122 aa, Artificial Sequence
  CD155 v172 IgV
WPPPGTGDVVVQEPTQVSGFLGDSVTLPCYLQVPNREVTHVSQLTWARHGESGSMAVFHQTKGPSYTESKRLEFVAARPGAELRDASLRMSGLRVEDEGNYTCLFVMFPQGSRSVDIWLRVL

SEQ ID NO: 1695 - protein, 122 aa, Artificial Sequence
  CD155 v173 IgV
WPPPGTGDIVVQAPTQVTGFLGDSVTLPCYLQVPNMEVTHVSQLTWARRGESGSMAVFHQTQGPSYSESKRLEFVAARPGAELRDASLRMSGLRVEDEGNYTCTFVMFPQGSRSVDIWLRVL

SEQ ID NO: 1696 - protein, 122 aa, Artificial Sequence
  CD155 v174 IgV
WPPPGTGDAVVQAPTQVFGFLGDSVTLPCYLQVPNMEVTHVSQLTWARHGESGSMAVFHQSLGPSYSESKRLEFVAARPGAELRNASLRMSGLRVEDEGNYTCLFVTFPQRSRSVDIWLRVL

SEQ ID NO: 1697 - protein, 122 aa, Artificial Sequence
  CD155 v175 IgV
WPPPGTGEVVVQAPTQVTGFLGDSVTLPCYLQVPNMEVTHVSQLTWARHGESGSMAVFHQAQGPSYSESKRLEFVAARPGAELRNASLRMSGLRVEDEGNYTCLFVMFPQGSRSVDIWLRVL

SEQ ID NO: 1698 - protein, 122 aa, Artificial Sequence
  CD155 v176 IgV
WPPPGTGDVVVQAPTQVSGFLGDSVTLPCYLQVPNMEVTHASQLTWARRGESGCMAVFHQTQGPSYSESKRLEFVAARSGAELRYASPRMSGLRVEDEGNYTCMFVMFPQGSRSVDIWLRVL

SEQ ID NO: 1699 - protein, 122 aa, Artificial Sequence
  CD155 v177 IgV
WPPPGTGDVVEQAPTQVHGYLGDSETLPCYLQVPSMEVTHVSQLTWARRGESGSMAVFHQTQGPSYSESKRLEFVAARPGAELRNASLRMSGLRVEDEGNYTCLFVMFPQRSRSVDIWLRVL

SEQ ID NO: 1700 - protein, 122 aa, Artificial Sequence
  CD155 v178 IgV
WPPPGTGDVVAQAPTQVFGFLGASVTLPCYLQVPNMEVTHVSQLTWARHGESGSMAVFHQTQGPSYSESKRLEFVAARPDAELRNASLRMFGLRAEDEGNYTCLFVMFPQGSRSVDIWLRVL

SEQ ID NO: 1701 - protein, 122 aa, Artificial Sequence
  CD155 v179 IgV
WPPPGTGDVVVQAPTQVSGFLGDSVTLPCYLQVPNMEVTHVSQLTWARHGESGSMAVFHQTQGPSYSESRRLEFVAARPGAELRNASLRMSGLRVEDEGNYTCLFVTFPQRSRSVDIWLRVL

SEQ ID NO: 1702 - protein, 122 aa, Artificial Sequence
  CD155 v180 IgV
WPPPGTGDLVMQAPTQVSGFLGDSVTLPCYLQVPSMEVTHVSQLTWARHGESGGMAVFHQTKGPSYSESKRLEFVAARPGAELRNASLRMFGLRVEDEGNYTCMFVMFPQGSRSMDIWLRVL

SEQ ID NO: 1703 - protein, 122 aa, Artificial Sequence
  CD155 v181 IgV
WPPPGTGDLVVQAPTQVYGFLGDSATLPCYLQVPNMEGTHVSQLTWARHGESGSVAVFHQTQGPSYSESKRLEFVATRPGAELRNASLRISGLRVEDEGNYTCMFVTFPQGSRSVDIWLRVL

SEQ ID NO: 1704 - protein, 122 aa, Artificial Sequence
  CD155 v182 IgV
WPPPGTGDVGVQAPTQVTGFLGDSVTLPCYLQVPNMEVTHVSQLTWARHGESGSMAVFHQTQGPSYSESKRQEFVAARPGAELRNASLRMSGLRVEDEGNYTCLFVMFPQGSRSVDIWLRVL

SEQ ID NO: 1705 - protein, 122 aa, Artificial Sequence
  CD155 v183 IgV
WPPPGTGDVVVQAPTQVSGFLGDSVTLPCYLQVPNMEVTHVSQLTWARHGESGSMAVFRQTQGPSYSESKRLEFVGASPGAELRNASLRMFGLRVEDEGNYTCLFVTFPQGSRSVDIWLRVL

SEQ ID NO: 1706 - protein, 122 aa, Artificial Sequence
  CD155 v184 IgV
WPPPGTGDAVVQAPTQVSGFLGDSVTLPCYLQVPNTEVTHVSQLTWARHGESGSMAVFHQTQGPGYSESKRLEFVAARPGAELRNASLRMSGLRVEDEGNYTCTFVTFPQRIRSVDIWLRVL

SEQ ID NO: 1707 - protein, 122 aa, Artificial Sequence
  CD155 v185 IgV
WPPPGTGDVVVQAPTQVTGFLGDSVTLPCYLQVPNMEVTHVSQLTWARHGEAGSMAAFHRTKGPCYSESKRLEFVAARPGAELRNASLRMTGLRVEDEGYYTCLFVMFPQGSRSVDIWLRVL

SEQ ID NO: 1708 - protein, 122 aa, Artificial Sequence
  CD155 v186 IgV
WPPPGTGDVVAQAPTQVFGFLGDSVTLPCYLQVPDMEVTHVSQLTWERHGESGSMAVFHQTKGPSYSESKRLEFVAARPGAELRNASLRMSGLRVEDEDNYTCLFVMFPQGSRNVDIWLRVL

SEQ ID NO: 1709 - protein, 122 aa, Artificial Sequence
  CD155 v187 IgV
WPPPGTGDVVAQAPTQVTGFLGDSVTLPCYLQVPSMEVTHVSQLTWARHGESGSMAVFHQTQGPSYSESKRLEFVAARPGAELRNATLRMSGLRVEDEGNYTCLFVTFPQGSRSVDIWLRVL

SEQ ID NO: 1710 - protein, 122 aa, Artificial Sequence
  CD155 v188 IgV
WPPPGTGDDVMLAPTQVSGFLGDSVTLPCYLQVPNMVVTHVSQLTWARHGESGSIAVFHRTQGPSYSESQRLEFVAARPGAELRNASLRMSGLRVEDEGNYTCMFVMFPQGSRSVDIWLRVL

SEQ ID NO: 1711 - protein, 122 aa, Artificial Sequence
  CD155 v189 IgV
WPPPGTGDVVVQAPSQVSGFLGDSVTLPCHLLVPNMEVTHVSQLTWARHGESGSMAVFHQTRGPSYSESKRLEFVAARPGAELRNASLRMSGLRVEDEGNYTCLFVMFPQGSRSVDIWLRVL

SEQ ID NO: 1712 - protein, 231 aa, Artificial Sequence
  Stack Fc Lysine removed (homodimeric)
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1713 - protein, 231 aa, artificial Sequence
  Fc (C5S (C220S), R77C, (R292C),  N82G (N297G), V87C (V302C), L232del (K447del))
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1714 - protein, 231 aa, Artificial Sequence
  Fc with C220S/L234A/L235E/G237A/K447del
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1715 - protein, 230 aa, Artificial Sequence
  Fc with C220S/E233P/L234V/L235A/G236del/S267K/K447del
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1716 - protein, 7 aa, Artificial Sequence
  Linker
GSGGGGS

SEQ ID NO: 1717 - protein, 5 aa, Artificial Sequence
  4GS Linker
GGGGS

SEQ ID NO: 1718 - protein, 221 aa, Artificial Sequence
  PD-L1 ECD v66
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1719 - protein, 108 aa, Artificial Sequence
  PD-L1 IgV 66
PKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGGADYKRITVKV

SEQ ID NO: 1720 - protein, 115 aa, Artificial Sequence
  PD-L1 IgV v66
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGGADYKRITVKVNA

SEQ ID NO: 1721 - protein, 221 aa, Homo sapiens [sequence omitted]

SEQ ID NO: 1722 - protein, 221 aa, Artificial Sequence
  PD-L1 ECD v67
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1723 - protein, 221 aa, Artificial Sequence
  PD-L1 ECD v68
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEILYCTFRRLDPEENHTAELVIPELPLAHPPNERT

SEQ ID NO: 1724 - protein, 221 aa, Artificial Sequence
  PD-L1 ECD v69
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVTSTLRINTTTNEIFYCTSRGLDPEKNQTAELVIPELPLAHPPNERT

SEQ ID NO: 1725 - protein, 221 aa, Artificial Sequence
  PD-L1 ECD v70
FTVTVPKDLYVVEYGSNMTIECKFPVEKQLDLAALSVYWEKEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPQAEVIWTSSDHQVLSGKTTTTNSKREEKLFNVTSTLRINTTTNEIFYCTFRGLDPEKNQTAEFVIPELPLAHPPNERT

SEQ ID NO: 1726 - protein, 221 aa, Artificial Sequence
  PD-L1 ECD v71
FTVTVPKDLYVVEYGSNMTIERKFPVEKQLDLAALIVYWEMEDKNIIQFVHGEEDLKVQHSSYRLRARLLKDQLSLGNAALQITDVKLQDAGVYRCMISYGGADYKRITVKVNAPYNKINQRISVVDPVTSEHELTCQAEGYPQAEVIWTSSDHQVLSGKTTTTNSKREEKLFNVTSTLRINTTTNEIFYCTFRGLDPENNQTAELVIPELPLAHPPNERL

SEQ ID NO: 1727 - protein, 221 aa, Artificial Sequence
  PD-L1 ECD v72
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCMLSYGGADYKRITVKVNAPYNKINQRISVVDPVTSEHELTCQAEGYPKAEVIWTSSDHQVLSGKTTTTNSKREEKLFNVTSTLRINTTTNEIFYCTFRRLDTEENHTAEFVIPELPLAHPPNERT

SEQ ID NO: 1728 - protein, 221 aa, Artificial Sequence
  PD-L1 ECD v73
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYSKINQRILVVDPVTSEHELTCQAEGYPKAEVVWTSSDHQVLSGKTTTTNSKREERLFNVTSTLSINTTTNEIFYCTFRRLDPEENHTAELVIPELPLAHPPNERT

SEQ ID NO: 1729 - protein, 221 aa, Artificial Sequence
  PD-L1 ECD v74
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGVDYKRITVKVNAPYNKINQRILVVDPVTSEHELTCQAEGYPKAEVIWTSSDHHVLSGKTTTTNSKREEKLFNVTSTLRINTTTNEIFYCTFRRLDPEENHTAELVIPELPLAHPPNERT

SEQ ID NO: 1730 - protein, 221 aa, Artificial Sequence
  PD-L1 ECD v75
FTVTVPKDLYVVEYGSNMTIECKFPVEIQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1731 - protein, 221 aa, Artificial Sequence
  PD-L1 ECD v76
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1732 - protein, 221 aa, Artificial Sequence
  PD-L1 ECD v77
FTVTVPKDLYVVEYGSNMTIECKFPVEKQLDLAALIVYWEMEDKNIIQFVHGEEDLKVQHSSYRQRARLLKDQLSLGNTALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTANEIFYCTFRGLDPEKNQTAEFVIPELPLAHPPNERT

SEQ ID NO: 1733 - protein, 221 aa, Artificial Sequence
  PD-L1 ECD v78
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRISVVDPVTSEHELTCQAEGYPQAEVIWTSSDHQVLSGKTTTTNSKREEKLFNVTSTLRINTTTNEIFYCTFRRLDPEENHTAELVIPELPLAHPPNERT

SEQ ID NO: 1734 - protein, 221 aa, Artificial Sequence
  PD-L1 ECD v79
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1735 - protein, 221 aa, Artificial Sequence
  PD-L1 ECD v80
FTVTVPKDLYVVEYGSNMTIECKFPVEKQLDLAALIVYWEMEDKNIIQFVHGEEVLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1736 - protein, 221 aa, Artificial Sequence
  PD-L1 ECD v81
FTVTVPKDLYVVEYGSNMTIECKFPVGKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1737 - protein, 221 aa, Artificial Sequence
  PD-L1 ECD v82
FTVTVPKDLYVVEYGSNMTIECKFPVEKQLDLAALIVYWEMEDKNIIQFVHGEGDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1738 - protein, 221 aa, Artificial Sequence
  PD-L1 ECD v83
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENQTAELVIPELPLAHPPNERT

SEQ ID NO: 1739 - protein, 221 aa, Artificial Sequence
  PD-L1 ECD v84
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1740 - protein, 221 aa, Artificial Sequence
  PD-L1 ECD v85
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1741 - protein, 221 aa, Artificial Sequence
  PD-L1 ECD v86
FTVTVPKDLYVVEYASNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1742 - protein, 221 aa, Artificial Sequence
  PD-L1 ECD v87
FTVTVPKDLYVVEYGSNMTIECKFPVEKQLDLAALSVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1743 - protein, 221 aa, Artificial Sequence
  PD-L1 ECD v88
FTVTVPKDLYVVEYGSNMTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTTELVIPELPLAHPPNERT

SEQ ID NO: 1744 - protein, 221 aa, Artificial Sequence
  PD-L1 ECD v89
FTVTVPKDLYVVEYGSNMTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPATSEHELTCQAEGYPKAEVIWTSSDHQVLSGKTTTTNSKREEKLLNVTSTLRINTTTNEIFYCTFRRLDPEENHTAELVIPELPLAHPPNERT

SEQ ID NO: 1745 - protein, 221 aa, Artificial Sequence
  PD-L1 ECD v90
FTVTVPKDLYVVEYGSNMTIECKFPVEKQLDLAALTVYWEMEDKNIIQFVHGEESLKVQHSSYRQRARLLKDQLSLGNAALQITDVKLQDAGVYRCLISYGGADYKRITVEVNAPYNKINQRILVVDPVTSEHELTCQAEGYPKAEVVWTSSDHQVLSGKTTTTNSKREEKLFNVTSTLSINTTTNEIFYCTFRRLDPEENHTAELVIPELPLAHPPNERT

SEQ ID NO: 1746 - protein, 221 aa, Artificial Sequence
  PD-L1 ECD v91
FTVTVPKDLYVVEYGSNMTIECKFPVEKQLDLAALTVYWEMEDKNIIQFVHREEDLKVQHSSYRQRARLLKDQLSLGNAALQITDVKLQDAGVYRCLISYGGADYKRITVKANAPYNKINQRILVVDPVTSEHELTCQAEGYPEAEVIWTSSDHQVLSGKTTTTNSKREEKLFNATSTLRINTTTNEIFYCTFRRLDTEENHTAELVIPELPLAHPPNERT

SEQ ID NO: 1747 - protein, 221 aa, Artificial Sequence
  PD-L1 ECD v92
FTVTVPKDLYVVEYGSNMTIECKFPVEKQLDLAALTVYWEMEDKNVIQFVHGEEGLKVQHSSYRQRARLLKDQLSLGNAALQITDVKLQDAGVYRCLISYGGADYERITVKVNAPYNKINQRILVVDPVTSEHELTCQAEGYPEAEVIWTSSDHQVLSGKTTTTNSKREEKLFNVTSTLRINTTANEIFYCTFRGLDPEENHTAELVIPELPLAHPPNERT

SEQ ID NO: 1748 - protein, 221 aa, Artificial Sequence
  PD-L1 ECD v93
FTVTVPKDLYVVEYGSNMTIECKFPVEKQLDLAALTVYWEMEDKNIIQFVHGEEDLKVQHSSYRQRARLLKDQLSLGNAALQTTDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDTEENHTAELVIPELPLAHPPNERT

SEQ ID NO: 1749 - protein, 221 aa, Artificial Sequence
  PD-L1 ECD v94
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1750 - protein, 221 aa, Artificial Sequence
  PD-L1 ECD v95
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDTEENHTAELVIPELPLAHPPNERT

SEQ ID NO: 1751 - protein, 221 aa, Artificial Sequence
  PD-L1 ECD v96
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHHVLSGKTTTTNSKREEKLFNVTSTLRINTTTNEIFYCTSRRLDPEEYHTAELVIPELPLAHPPNERT

SEQ ID NO: 1752 - protein, 221 aa, Artificial Sequence
  PD-L1 ECD v97
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1753 - protein, 221 aa, Artificial Sequence
  PD-L1 ECD v98
FTVTVPKDLYVVEYGSNMTIECKFPVEKQLDLAAPSVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1754 - protein, 221 aa, Artificial Sequence
  PD-L1 ECD v99
FTVTVPKDLYVVEYGSNITIECKFPVEKQLDLAALTVYWEMEDKNIIQFVHGGEDLKVQHSSYRQRARLLKDQLSLGNAALQITDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDPGENHTAELAIPELPLAHPPNERT

SEQ ID NO: 1755 - protein, 221 aa, Artificial Sequence
  PD-L1 ECD v100
FTVTVPKDLYVVEYGSNTTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1756 - protein, 221 aa, Artificial Sequence
  PD-L1 ECD v101
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVNSTLRINTTTNEIFYCTFRGLDPEENHTAELVIPELPLAHPPNERT

SEQ ID NO: 1757 - protein, 221 aa, Artificial Sequence
  PD-L1 ECD v102
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1758 - protein, 221 aa, Artificial Sequence
  PD-L1 ECD v103
FTVTVPKDLYVVEYGSDMTIECKFPVEKQLDLAALIVYWEMEDKNIIQFVHGEEDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1759 - protein, 221 aa, Artificial Sequence
  PD-L1 ECD v104
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTANEIFYCTFRGLDTEENHTAELVIPELPLAHPPNERT

SEQ ID NO: 1760 - protein, 221 aa, Artificial Sequence
  PD-L1 ECD v105
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENQTAELVIPELPLAHPPNERT

SEQ ID NO: 1761 - protein, 221 aa, Artificial Sequence
  PD-L1 ECD v106
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDTEENHTAELVIPELPLAHPPNERT

SEQ ID NO: 1762 - protein, 221 aa, Artificial Sequence
  PD-L1 ECD v107
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWASSDHQVLSGKTTTTNSKREEKLFNVTSTLRINTTTNEIFYCTFRRLDPEENHTAELVIPELPLAHPPNERT

SEQ ID NO: 1763 - protein, 221 aa, Artificial Sequence
  PD-L1 ECD v108
FTVTVPKDLYVVEYGSNMTIECKFPVEKQLDLAALIVYWEMEDKNIIQFVHGEEDLKVQHSSYRQRARLLKDQLSLGNAALQITDVKLQDAGEYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1764 - protein, 221 aa, Artificial Sequence
  PD-L1 ECD v109
FTVTVPKDLFVVEYGSNVTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCRAEGYPKAEVIWTSSDHQVLSGKTTTTNSKREEKLFNVTSTLRINTTTNEIFYCTFRRLDPEENHAAELVIPELPLAHPPNERT

SEQ ID NO: 1765 - protein, 221 aa, Artificial Sequence
  PD-L1 ECD v110
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1766 - protein, 221 aa, Artificial Sequence
  PD-L1 ECD v111
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGMTTTTNSKREEKLFNVTSTLRINTTTNEIFYCTFRGLDPEENHTAELVIPELPLAHPPNERT

SEQ ID NO: 1767 - protein, 221 aa, Artificial Sequence
  PD-L1 ECD v112
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDPEENHTAELVIPELPLAHPPNERT

SEQ ID NO: 1768 - protein, 221 aa, Artificial Sequence
  PD-L1 ECD v113
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNERT

SEQ ID NO: 1769 - protein, 221 aa, Artificial Sequence
  PD-L1 ECD v114
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDTEENHTAELVIPELPLAHPPNERT

SEQ ID NO: 1770 - protein, 221 aa, Artificial Sequence
  PD-L1 ECD v115
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1771 - protein, 221 aa, Artificial Sequence
  PD-L1 ECD v116
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1772 - protein, 221 aa, Artificial Sequence
  PD-L1 ECD v117
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTFEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1773 - protein, 221 aa, Artificial Sequence
  PD-L1 ECD v118
FTVTVPKDLYVVEYGSNMTIECKFPVEKQLDLAALIVYWEMEDKDIIQFVHGEEDLKDQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1774 - protein, 221 aa, Artificial Sequence
  PD-L1 ECD v119
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1775 - protein, 221 aa, Artificial Sequence
  PD-L1 ECD v120
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMTSYGGADYKRITVKVNAPYNKINQRILVVDPVTSEHELTCQAEGYPKAEVIWTSSDHQVLSGKTTTTNSKREEKLYNVTSTLRINTTTNEIFYCTFRRSDPEENHTAELVIPELPLAHPPNERT

SEQ ID NO: 1776 - protein, 221 aa, Artificial Sequence
  PD-L1 ECD v121
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHGLTCQAEGYPKAEVIWTSSDHQVLSGKTTTTNSKREEKLFNVTSTLRINTTTNEIFYCTFRRLDPEENHTAELVIPELPPAHPPNERT

SEQ ID NO: 1777 - protein, 221 aa, Artificial Sequence
  PD-L1 ECD v122
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLINVTCTLRINTTTNEIFYCTFRRLDPEENHTAELVIPELPLAHPPNERT

SEQ ID NO: 1778 - protein, 221 aa, Artificial Sequence
  PD-L1 ECD v123
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEENHTAELVIPELPLAHPPNERT

SEQ ID NO: 1779 - protein, 221 aa, Artificial Sequence
  PD-L1 ECD v124
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVTVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1780 - protein, 221 aa, Artificial Sequence
  PD-L1 ECD v125
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVYAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1781 - protein, 221 aa, Artificial Sequence
  PD-L1 ECD v126
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTYSKREGKLFNVTSTLRINTTTNEIFYCTFRRLDPEENHTAELVIPELPLAHPPNERT

SEQ ID NO: 1782 - protein, 221 aa, Artificial Sequence
  PD-L1 ECD v127
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMVSYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1783 - protein, 221 aa, Artificial Sequence
  PD-L1 ECD v128
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTFEHELTCQAEGYPKAEVIWTSSDHQVLSGKTTTTNSKREEKLFNVTSTLRINTTTNEIFYCTFRRLDSEENHTAELVIPELPLAHPPNERT

SEQ ID NO: 1784 - protein, 221 aa, Artificial Sequence
  PD-L1 ECD v129
FTVTVPKDLYVVEYGSNMTIECKFPVEKQLDLAALIVYWEMEDKDIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNERT

SEQ ID NO: 1785 - protein, 221 aa, Artificial Sequence
  PD-L1 ECD v131
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRTLDPEENHTAELVIPELPLAHPPNERT

SEQ ID NO: 1786 - protein, 221 aa, Artificial Sequence
  PD-L1 ECD v131
FTVTVPKDLYVVEYGSNMTIECKFPVDKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINATTNEVFYCTFRRLDPEENHTAELVIPELPLAHPPNERT

SEQ ID NO: 1787 - protein, 221 aa, Artificial Sequence
  PD-L1 ECD v132
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLYNVTSTLRINITTNEIFYCTFRRSDPEENHAAELVIPELPLAHPPNERT

SEQ ID NO: 1788 - protein, 221 aa, Artificial Sequence
  PD-L1 ECD v133
FTVTVPKDLYVVEYGSNMTIECNFPVEKQLDLAALIVYWEMEDKDIIQFVHGEEDLKVQHSSYRQRARLLKDQLPLGNAALQITDVKLQDAGVYRCMISYGGADYKRITVKVNAPYNKISQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1789 - protein, 221 aa, Artificial Sequence
  PD-L1 ECD v134
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGDADYKRITVKVNAPYNKINQRILVVDPVTSEHELTCQAEGYPKAEVIWTSSDHQVLSGKTTTTNSKREEKLFNVTSTLRINTTTNEIFYCTFWGLDPEENHTAELVIPELPLAHPPNERT

SEQ ID NO: 1790 - protein, 221 aa, Artificial Sequence
  PD-L1 ECD v135
FTVTVPKDLYVVEYGSNMTIECKFPVEKQLDLAALIVYWEMEDKDIIQFVHVEEDLKVQHSSYRQRARLLKDQLSLGNAALQITDVKLQDAGVYRCMISYGGADYKRITVKVNAPYNKINLRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNERT

SEQ ID NO: 1791 - protein, 221 aa, Artificial Sequence
  PD-L1 ECD v136
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEEDHTAELVIPELPLAHPPNERT

SEQ ID NO: 1792 - protein, 221 aa, Artificial Sequence
  PD-L1 ECD v137
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVTVNAPYNKINQRILVVDPVTSEHELTCQAEGYPKAEVIWTSSDHQVLSGKTTTTNSKREEKLFNVTSTLRINATTNEVFYCTFRRLDPEENHTAELVIPELPLAHPPNERT

SEQ ID NO: 1793 - protein, 221 aa, Artificial Sequence
  PD-L1 ECD v138
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEISYCTFRRLDSEENHTAELVIPELPLAHPPNERT

SEQ ID NO: 1794 - protein, 221 aa, Artificial Sequence
  PD-L1 ECD v139
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMIGYGGADYKRITVKVNAPYNKINQRILVVDPVTSEHELTRQAEGYPKAEVIWTSSDHQVLSGKTTTTNSKREEKLFNVTSTLRINTTTNEIFYCTFRRLDPEENHTAELAIPELPLAHPPNERT

SEQ ID NO: 1795 - protein, 221 aa, Artificial Sequence
  PD-L1 ECD v140
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTITNSRREEKLFNVTSTLRINTTTNEIFYCTFRGLDPEENHTAELVIPELPLAHPPNERT

SEQ ID NO: 1796 - protein, 221 aa, Artificial Sequence
  PD-L1 ECD v141
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINATTNEIFYCSFGRLDPEENHTAELVIPELPLAHPPNERT

SEQ ID NO: 1797 - protein, 221 aa, Artificial Sequence
  PD-L1 ECD v142
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKTNQRILVVDPVTSEHELTCQAEGYPEAEVIWTSSDHQVLSGKTTTTNSKREEKLFNVTSTLRINTTTNEIFYCTFRRLDPEENHTAELVIPELPLAHPPNERT

SEQ ID NO: 1798 - protein, 221 aa, Artificial Sequence
  PD-L1 ECD v143
FTVTVPKDLYVVEYGSNMAIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPEAEVIWTSSDHQVLSGKTTTTNSKREEKLFNVTSTLRINTTTNEIFYCTFRGLDPEENHTAELVIPELPLAHPPNERT

SEQ ID NO: 1799 - protein, 221 aa, Artificial Sequence
  PD-L1 ECD v144
FTVTVPKDLYEVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVASEHELTCQAEGYPKAEVIWTSSDHQVLSGKTTTTNSKREEKLFNVTSTLRINTTTNEIFYCTFRRLDTEENHTAELVIPELPLAHPPNERT

SEQ ID NO: 1800 - protein, 221 aa, Artificial Sequence
  PD-L1 ECD v145
FTVTVPKDLYVVEYGSNMTIECKFPAEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTITNSKREEKLFNVTSTLRINTTANEIFYCTFRRLDPEENHTAELVIPELPLAHPPNERT

SEQ ID NO: 1801 - protein, 221 aa, Artificial Sequence
  PD-L1 ECD v146
FTVTVPKDLYVVEYGSNMTIECNFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRISVVDPVTSEHELTCQAEGYPKAEVIWTSSDHQVLSGKTTTTNSTREEKLFNVTSTLRINTTTNEIFYCTFRGLDPEENHTAELVIPELPLAHPPNERT

SEQ ID NO: 1802 - protein, 221 aa, Artificial Sequence
  PD-L1 ECD v147
FTVTVPKDLYVVEYGSNMTIECNFPVEKQLDLAALIVYWEMEDKDIIQFVHGEEDLKVQHSSYRQRARLLKDRLSLGNAALQITDVKLQDAGVYRCMISYGGADYKRITVKVNAPYNKINQRILVVDPVTSEHELTCQAEGYPKAEVIWTSSDHQVLSGKTTITNSKREEKLFNVTSTLRINTTTNEIFYCTFRRLDPEENHTAELVIPELPLAHPPNERT

SEQ ID NO: 1803 - protein, 221 aa, Artificial Sequence
  PD-L1 ECD v148
FTVTVPKDLYVVEYGSNMTIECKFPVEEQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIRTSSDHQVLGGKTTTTNSKREEKLFNVTSTLRINTTTNEIFYCTFRRLDTEENHTAELVIPELPLAHPPNERT

SEQ ID NO: 1804 - protein, 221 aa, Artificial Sequence
  PD-L1 ECD v149
FTVTVPKDLYVVEYGSNMTIECKFPVERQLDLAALIVYWEMEDKDIIQFVHGEEDLEVQHSSYRQRARLLKDQLSLGNAALQITDVKLQDAGVYRCMVSYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1805 - protein, 221 aa, Artificial Sequence
  PD-L1 ECD v150
FTVTVPKDLYVVEYGSNMTIECKFPVERQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTNTNSKREEKLFNVTSTLRINTTTNEIFYCTFRTLDPEENHTAELVIPELPLAHPPNERT

SEQ ID NO: 1806 - protein, 221 aa, Artificial Sequence
  PD-L1 ECD v151
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1807 - protein, 221 aa, Artificial Sequence
  PD-L1 ECD v152
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1808 - protein, 221 aa, Artificial Sequence
  PD-L1 ECD v153
FTVTVPKDLYVVEYGSNMTIECKFPVEKQLDLAALIVYWEMEDKDIIQFVHGEEDLKVQHSSYRQRALLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTTNEIFYCTFRRLGSEENHTAELVIPELPLAHPPNERT

SEQ ID NO: 1809 - protein, 221 aa, Artificial Sequence
  PD-L1 ECD v154
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEEDHTAELVIPELPLAHPPNERT

SEQ ID NO: 1810 - protein, 221 aa, Artificial Sequence
  PD-L1 ECD v155
FTVTVPKDLYVVEYGSNMTIECKFPVEKQLDLAALIVYWEKEGEDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEEDHTAELVIPELPLAHPPNERT

SEQ ID NO: 1811 - protein, 221 aa, Artificial Sequence
  PD-L1 ECD v156
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRISVVDPVTSEHELTCQAEGYPEAEVIWTSSDHQVLSGKTTTTNSKREEKLFNVTSTPRINTTTNEIFYCTFRGLDPEENHTAELVIPELPLAHPPNERT

SEQ ID NO: 1812 - protein, 220 aa, Artificial Sequence
  PD-L1 ECD v67
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1813 - protein, 220 aa, Artificial Sequence
  PD-L1 ECD v68
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEILYCTFRRLDPEENHTAELVIPELPLAHPPNER

SEQ ID NO: 1814 - protein, 220 aa, Artificial Sequence
  PD-L1 ECD v69
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVTSTLRINTTTNEIFYCTSRGLDPEKNQTAELVIPELPLAHPPNER

SEQ ID NO: 1815 - protein, 220 aa, Artificial Sequence
  PD-L1 ECD v70
FTVTVPKDLYVVEYGSNMTIECKFPVEKQLDLAALSVYWEKEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPQAEVIWTSSDHQVLSGKTTTTNSKREEKLFNVTSTLRINTTTNEIFYCTFRGLDPEKNQTAEFVIPELPLAHPPNER

SEQ ID NO: 1816 - protein, 220 aa, Artificial Sequence
  PD-L1 ECD v72
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCMLSYGGADYKRITVKVNAPYNKINQRISVVDPVTSEHELTCQAEGYPKAEVIWTSSDHQVLSGKTTTTNSKREEKLFNVTSTLRINTTTNEIFYCTFRRLDTEENHTAEFVIPELPLAHPPNER

SEQ ID NO: 1817 - protein, 220 aa, Artificial Sequence
  PD-L1 ECD v73
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYSKINQRILVVDPVTSEHELTCQAEGYPKAEVVWTSSDHQVLSGKTTTTNSKREERLFNVTSTLSINTTTNEIFYCTFRRLDPEENHTAELVIPELPLAHPPNER

SEQ ID NO: 1818 - protein, 220 aa, Artificial Sequence
  PD-L1 ECD v74
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGVDYKRITVKVNAPYNKINQRILVVDPVTSEHELTCQAEGYPKAEVIWTSSDHHVLSGKTTTTNSKREEKLFNVTSTLRINTTTNEIFYCTFRRLDPEENHTAELVIPELPLAHPPNER

SEQ ID NO: 1819 - protein, 220 aa, Artificial Sequence
  PD-L1 ECD v75
FTVTVPKDLYVVEYGSNMTIECKFPVEIQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1820 - protein, 220 aa, Artificial Sequence
  PD-L1 ECD v76
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1821 - protein, 220 aa, Artificial Sequence
  PD-L1 ECD v77
FTVTVPKDLYVVEYGSNMTIECKFPVEKQLDLAALIVYWEMEDKNIIQFVHGEEDLKVQHSSYRQRARLLKDQLSLGNTALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTANEIFYCTFRGLDPEKNQTAEFVIPELPLAHPPNER

SEQ ID NO: 1822 - protein, 220 aa, Artificial Sequence
  PD-L1 ECD v78
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRISVVDPVTSEHELTCQAEGYPQAEVIWTSSDHQVLSGKTTTTNSKREEKLFNVTSTLRINTTTNEIFYCTFRRLDPEENHTAELVIPELPLAHPPNER

SEQ ID NO: 1823 - protein, 220 aa, Artificial Sequence
  PD-L1 ECD v79
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1824 - protein, 220 aa, Artificial Sequence
  PD-L1 ECD v80
FTVTVPKDLYVVEYGSNMTIECKFPVEKQLDLAALIVYWEMEDKNIIQFVHGEEVLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1825 - protein, 220 aa, Artificial Sequence
  PD-L1 ECD v81
FTVTVPKDLYVVEYGSNMTIECKFPVGKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1826 - protein, 220 aa, Artificial Sequence
  PD-L1 ECD v82
FTVTVPKDLYVVEYGSNMTIECKFPVEKQLDLAALIVYWEMEDKNIIQFVHGEGDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1827 - protein, 220 aa, Artificial Sequence
  PD-L1 ECD v83
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENQTAELVIPELPLAHPPNER

SEQ ID NO: 1828 - protein, 220 aa, Artificial Sequence
  PD-L1 ECD v84
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1829 - protein, 220 aa, Artificial Sequence
  PD-L1 ECD v85
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1830 - protein, 220 aa, Artificial Sequence
  PD-L1 ECD v86
FTVTVPKDLYVVEYASNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1831 - protein, 220 aa, Artificial Sequence
  PD-L1 ECD v87
FTVTVPKDLYVVEYGSNMTIECKFPVEKQLDLAALSVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1832 - protein, 220 aa, Artificial Sequence
  PD-L1 ECD v88
FTVTVPKDLYVVEYGSNMTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTTELVIPELPLAHPPNER

SEQ ID NO: 1833 - protein, 220 aa, Artificial Sequence
  PD-L1 ECD v89
FTVTVPKDLYVVEYGSNMTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPATSEHELTCQAEGYPKAEVIWTSSDHQVLSGKTTTTNSKREEKLLNVTSTLRINTTTNEIFYCTFRRLDPEENHTAELVIPELPLAHPPNER

SEQ ID NO: 1834 - protein, 220 aa, Artificial Sequence
  PD-L1 ECD v90
FTVTVPKDLYVVEYGSNMTIECKFPVEKQLDLAALTVYWEMEDKNIIQFVHGEESLKVQHSSYRQRARLLKDQLSLGNAALQITDVKLQDAGVYRCLISYGGADYKRITVEVNAPYNKINQRILVVDPVTSEHELTCQAEGYPKAEVVWTSSDHQVLSGKTTTTNSKREEKLFNVTSTLSINTTTNEIFYCTFRRLDPEENHTAELVIPELPLAHPPNER

SEQ ID NO: 1835 - protein, 220 aa, Artificial Sequence
  PD-L1 ECD v91
FTVTVPKDLYVVEYGSNMTIECKFPVEKQLDLAALTVYWEMEDKNIIQFVHREEDLKVQHSSYRQRARLLKDQLSLGNAALQITDVKLQDAGVYRCLISYGGADYKRITVKANAPYNKINQRILVVDPVTSEHELTCQAEGYPEAEVIWTSSDHQVLSGKTTTTNSKREEKLFNATSTLRINTTTNEIFYCTFRRLDTEENHTAELVIPELPLAHPPNER

SEQ ID NO: 1836 - protein, 220 aa, Artificial Sequence
  PD-L1 ECD v92
FTVTVPKDLYVVEYGSNMTIECKFPVEKQLDLAALTVYWEMEDKNVIQFVHGEEGLKVQHSSYRQRARLLKDQLSLGNAALQITDVKLQDAGVYRCLISYGGADYERITVKVNAPYNKINQRILVVDPVTSEHELTCQAEGYPEAEVIWTSSDHQVLSGKTTTTNSKREEKLFNVTSTLRINTTANEIFYCTFRGLDPEENHTAELVIPELPLAHPPNER

SEQ ID NO: 1837 - protein, 220 aa, Artificial Sequence
  PD-L1 ECD v93
FTVTVPKDLYVVEYGSNMTIECKFPVEKQLDLAALTVYWEMEDKNIIQFVHGEEDLKVQHSSYRQRARLLKDQLSLGNAALQTTDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDTEENHTAELVIPELPLAHPPNER

SEQ ID NO: 1838 - protein, 220 aa, Artificial Sequence
  PD-L1 ECD v94
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1839 - protein, 220 aa, Artificial Sequence
  PD-L1 ECD v95
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDTEENHTAELVIPELPLAHPPNER

SEQ ID NO: 1840 - protein, 220 aa, Artificial Sequence
  PD-L1 ECD v96
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHHVLSGKTTTTNSKREEKLFNVTSTLRINTTTNEIFYCTSRRLDPEEYHTAELVIPELPLAHPPNER

SEQ ID NO: 1841 - protein, 220 aa, Artificial Sequence
  PD-L1 ECD v97
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1842 - protein, 220 aa, Artificial Sequence
  PD-L1 ECD v98
FTVTVPKDLYVVEYGSNMTIECKFPVEKQLDLAAPSVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1843 - protein, 220 aa, Artificial Sequence
  PD-L1 ECD v99
FTVTVPKDLYVVEYGSNITIECKFPVEKQLDLAALTVYWEMEDKNIIQFVHGGEDLKVQHSSYRQRARLLKDQLSLGNAALQITDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDPGENHTAELAIPELPLAHPPNER

SEQ ID NO: 1844 - protein, 220 aa, Artificial Sequence
  PD-L1 ECD v100
FTVTVPKDLYVVEYGSNTTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1845 - protein, 220 aa, Artificial Sequence
  PD-L1 ECD v101
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVNSTLRINTTTNEIFYCTFRGLDPEENHTAELVIPELPLAHPPNER

SEQ ID NO: 1846 - protein, 220 aa, Artificial Sequence
  PD-L1 ECD v102
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1847 - protein, 220 aa, Artificial Sequence
  PD-L1 ECD v103
FTVTVPKDLYVVEYGSDMTIECKFPVEKQLDLAALIVYWEMEDKNIIQFVHGEEDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1848 - protein, 220 aa, Artificial Sequence
  PD-L1 ECD v104
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTANEIFYCTFRGLDTEENHTAELVIPELPLAHPPNER

SEQ ID NO: 1849 - protein, 220 aa, Artificial Sequence
  PD-L1 ECD v105
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENQTAELVIPELPLAHPPNER

SEQ ID NO: 1850 - protein, 220 aa, Artificial Sequence
  PD-L1 ECD v106
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDTEENHTAELVIPELPLAHPPNER

SEQ ID NO: 1851 - protein, 220 aa, Artificial Sequence
  PD-L1 ECD v107
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWASSDHQVLSGKTTTTNSKREEKLFNVTSTLRINTTTNEIFYCTFRRLDPEENHTAELVIPELPLAHPPNER

SEQ ID NO: 1852 - protein, 220 aa, Artificial Sequence
  PD-L1 ECD v108
FTVTVPKDLYVVEYGSNMTIECKFPVEKQLDLAALIVYWEMEDKNIIQFVHGEEDLKVQHSSYRQRARLLKDQLSLGNAALQITDVKLQDAGEYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1853 - protein, 220 aa, Artificial Sequence
  PD-L1 ECD v109
FTVTVPKDLFVVEYGSNVTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCRAEGYPKAEVIWTSSDHQVLSGKTTTTNSKREEKLFNVTSTLRINTTTNEIFYCTFRRLDPEENHAAELVIPELPLAHPPNER

SEQ ID NO: 1854 - protein, 220 aa, Artificial Sequence
  PD-L1 ECD v110
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1855 - protein, 220 aa, Artificial Sequence
  PD-L1 ECD v111
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGMTTTTNSKREEKLFNVTSTLRINTTTNEIFYCTFRGLDPEENHTAELVIPELPLAHPPNER

SEQ ID NO: 1856 - protein, 220 aa, Artificial Sequence
  PD-L1 ECD v112
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDPEENHTAELVIPELPLAHPPNER

SEQ ID NO: 1857 - protein, 220 aa, Artificial Sequence
  PD-L1 ECD v113
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNER

SEQ ID NO: 1858 - protein, 220 aa, Artificial Sequence
  PD-L1 ECD v114
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDTEENHTAELVIPELPLAHPPNER

SEQ ID NO: 1859 - protein, 220 aa, Artificial Sequence
  PD-L1 ECD v115
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1860 - protein, 220 aa, Artificial Sequence
  PD-L1 ECD v116
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1861 - protein, 220 aa, Artificial Sequence
  PD-L1 ECD v117
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTFEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1862 - protein, 220 aa, Artificial Sequence
  PD-L1 ECD v118
FTVTVPKDLYVVEYGSNMTIECKFPVEKQLDLAALIVYWEMEDKDIIQFVHGEEDLKDQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1863 - protein, 220 aa, Artificial Sequence
  PD-L1 ECD v119
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1864 - protein, 220 aa, Artificial Sequence
  PD-L1 ECD v120
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMTSYGGADYKRITVKVNAPYNKINQRILVVDPVTSEHELTCQAEGYPKAEVIWTSSDHQVLSGKTTTTNSKREEKLYNVTSTLRINTTTNEIFYCTFRRSDPEENHTAELVIPELPLAHPPNER

SEQ ID NO: 1865 - protein, 220 aa, Artificial Sequence
  PD-L1 ECD v121
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHGLTCQAEGYPKAEVIWTSSDHQVLSGKTTTTNSKREEKLFNVTSTLRINTTTNEIFYCTFRRLDPEENHTAELVIPELPPAHPPNER

SEQ ID NO: 1866 - protein, 220 aa, Artificial Sequence
  PD-L1 ECD v122
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLINVTCTLRINTTTNEIFYCTFRRLDPEENHTAELVIPELPLAHPPNER

SEQ ID NO: 1867 - protein, 220 aa, Artificial Sequence
  PD-L1 ECD v123
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEENHTAELVIPELPLAHPPNER

SEQ ID NO: 1868 - protein, 220 aa, Artificial Sequence
  PD-L1 ECD v124
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVTVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1869 - protein, 220 aa, Artificial Sequence
  PD-L1 ECD v125
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVYAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1870 - protein, 220 aa, Artificial Sequence
  PD-L1 ECD v126
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTYSKREGKLFNVTSTLRINTTTNEIFYCTFRRLDPEENHTAELVIPELPLAHPPNER

SEQ ID NO: 1871 - protein, 220 aa, Artificial Sequence
  PD-L1 ECD v127
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMVSYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1872 - protein, 220 aa, Artificial Sequence
  PD-L1 ECD v128
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTFEHELTCQAEGYPKAEVIWTSSDHQVLSGKTTTTNSKREEKLFNVTSTLRINTTTNEIFYCTFRRLDSEENHTAELVIPELPLAHPPNER

SEQ ID NO: 1873 - protein, 220 aa, Artificial Sequence
  PD-L1 ECD v129
FTVTVPKDLYVVEYGSNMTIECKFPVEKQLDLAALIVYWEMEDKDIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNER

SEQ ID NO: 1874 - protein, 220 aa, Artificial Sequence
  PD-L1 ECD v131
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRTLDPEENHTAELVIPELPLAHPPNER

SEQ ID NO: 1875 - protein, 220 aa, Artificial Sequence
  PD-L1 ECD v131
FTVTVPKDLYVVEYGSNMTIECKFPVDKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINATTNEVFYCTFRRLDPEENHTAELVIPELPLAHPPNER

SEQ ID NO: 1876 - protein, 220 aa, Artificial Sequence
  PD-L1 ECD v132
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLYNVTSTLRINITTNEIFYCTFRRSDPEENHAAELVIPELPLAHPPNER

SEQ ID NO: 1877 - protein, 220 aa, Artificial Sequence
  PD-L1 ECD v133
FTVTVPKDLYVVEYGSNMTIECNFPVEKQLDLAALIVYWEMEDKDIIQFVHGEEDLKVQHSSYRQRARLLKDQLPLGNAALQITDVKLQDAGVYRCMISYGGADYKRITVKVNAPYNKISQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1878 - protein, 220 aa, Artificial Sequence
  PD-L1 ECD v134
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGDADYKRITVKVNAPYNKINQRILVVDPVTSEHELTCQAEGYPKAEVIWTSSDHQVLSGKTTTTNSKREEKLFNVTSTLRINTTTNEIFYCTFWGLDPEENHTAELVIPELPLAHPPNER

SEQ ID NO: 1879 - protein, 220 aa, Artificial Sequence
  PD-L1 ECD v135
FTVTVPKDLYVVEYGSNMTIECKFPVEKQLDLAALIVYWEMEDKDIIQFVHVEEDLKVQHSSYRQRARLLKDQLSLGNAALQITDVKLQDAGVYRCMISYGGADYKRITVKVNAPYNKINLRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNER

SEQ ID NO: 1880 - protein, 220 aa, Artificial Sequence
  PD-L1 ECD v136
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEEDHTAELVIPELPLAHPPNER

SEQ ID NO: 1881 - protein, 220 aa, Artificial Sequence
  PD-L1 ECD v137
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVTVNAPYNKINQRILVVDPVTSEHELTCQAEGYPKAEVIWTSSDHQVLSGKTTTTNSKREEKLFNVTSTLRINATTNEVFYCTFRRLDPEENHTAELVIPELPLAHPPNER

SEQ ID NO: 1882 - protein, 220 aa, Artificial Sequence
  PD-L1 ECD v138
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEISYCTFRRLDSEENHTAELVIPELPLAHPPNER

SEQ ID NO: 1883 - protein, 220 aa, Artificial Sequence
  PD-L1 ECD v139
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMIGYGGADYKRITVKVNAPYNKINQRILVVDPVTSEHELTRQAEGYPKAEVIWTSSDHQVLSGKTTTTNSKREEKLFNVTSTLRINTTTNEIFYCTFRRLDPEENHTAELAIPELPLAHPPNER

SEQ ID NO: 1884 - protein, 220 aa, Artificial Sequence
  PD-L1 ECD v140
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTITNSRREEKLFNVTSTLRINTTTNEIFYCTFRGLDPEENHTAELVIPELPLAHPPNER

SEQ ID NO: 1885 - protein, 220 aa, Artificial Sequence
  PD-L1 ECD v141
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINATTNEIFYCSFGRLDPEENHTAELVIPELPLAHPPNER

SEQ ID NO: 1886 - protein, 220 aa, Artificial Sequence
  PD-L1 ECD v142
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKTNQRILVVDPVTSEHELTCQAEGYPEAEVIWTSSDHQVLSGKTTTTNSKREEKLFNVTSTLRINTTTNEIFYCTFRRLDPEENHTAELVIPELPLAHPPNER

SEQ ID NO: 1887 - protein, 220 aa, Artificial Sequence
  PD-L1 ECD v143
FTVTVPKDLYVVEYGSNMAIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPEAEVIWTSSDHQVLSGKTTTTNSKREEKLFNVTSTLRINTTTNEIFYCTFRGLDPEENHTAELVIPELPLAHPPNER

SEQ ID NO: 1888 - protein, 220 aa, Artificial Sequence
  PD-L1 ECD v144
FTVTVPKDLYEVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVASEHELTCQAEGYPKAEVIWTSSDHQVLSGKTTTTNSKREEKLFNVTSTLRINTTTNEIFYCTFRRLDTEENHTAELVIPELPLAHPPNER

SEQ ID NO: 1889 - protein, 220 aa, Artificial Sequence
  PD-L1 ECD v145
FTVTVPKDLYVVEYGSNMTIECKFPAEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTITNSKREEKLFNVTSTLRINTTANEIFYCTFRRLDPEENHTAELVIPELPLAHPPNER

SEQ ID NO: 1890 - protein, 220 aa, Artificial Sequence
  PD-L1 ECD v146
FTVTVPKDLYVVEYGSNMTIECNFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRISVVDPVTSEHELTCQAEGYPKAEVIWTSSDHQVLSGKTTTTNSTREEKLFNVTSTLRINTTTNEIFYCTFRGLDPEENHTAELVIPELPLAHPPNER

SEQ ID NO: 1891 - protein, 220 aa, Artificial Sequence
  PD-L1 ECD v147
FTVTVPKDLYVVEYGSNMTIECNFPVEKQLDLAALIVYWEMEDKDIIQFVHGEEDLKVQHSSYRQRARLLKDRLSLGNAALQITDVKLQDAGVYRCMISYGGADYKRITVKVNAPYNKINQRILVVDPVTSEHELTCQAEGYPKAEVIWTSSDHQVLSGKTTITNSKREEKLFNVTSTLRINTTTNEIFYCTFRRLDPEENHTAELVIPELPLAHPPNER

SEQ ID NO: 1892 - protein, 220 aa, Artificial Sequence
  PD-L1 ECD v148
FTVTVPKDLYVVEYGSNMTIECKFPVEEQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIRTSSDHQVLGGKTTTTNSKREEKLFNVTSTLRINTTTNEIFYCTFRRLDTEENHTAELVIPELPLAHPPNER

SEQ ID NO: 1893 - protein, 220 aa, Artificial Sequence
  PD-L1 ECD v149
FTVTVPKDLYVVEYGSNMTIECKFPVERQLDLAALIVYWEMEDKDIIQFVHGEEDLEVQHSSYRQRARLLKDQLSLGNAALQITDVKLQDAGVYRCMVSYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1894 - protein, 220 aa, Artificial Sequence
  PD-L1 ECD v150
FTVTVPKDLYVVEYGSNMTIECKFPVERQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTNTNSKREEKLFNVTSTLRINTTTNEIFYCTFRTLDPEENHTAELVIPELPLAHPPNER

SEQ ID NO: 1895 - protein, 220 aa, Artificial Sequence
  PD-L1 ECD v151
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1896 - protein, 220 aa, Artificial Sequence
  PD-L1 ECD v152
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1897 - protein, 220 aa, Artificial Sequence
  PD-L1 ECD v153
FTVTVPKDLYVVEYGSNMTIECKFPVEKQLDLAALIVYWEMEDKDIIQFVHGEEDLKVQHSSYRQRALLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTTNEIFYCTFRRLGSEENHTAELVIPELPLAHPPNER

SEQ ID NO: 1898 - protein, 220 aa, Artificial Sequence
  PD-L1 ECD v154
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEEDHTAELVIPELPLAHPPNER

SEQ ID NO: 1899 - protein, 220 aa, Artificial Sequence
  PD-L1 ECD v155
FTVTVPKDLYVVEYGSNMTIECKFPVEKQLDLAALIVYWEKEGEDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEEDHTAELVIPELPLAHPPNER

SEQ ID NO: 1900 - protein, 220 aa, Artificial Sequence
  PD-L1 ECD v156
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRISVVDPVTSEHELTCQAEGYPEAEVIWTSSDHQVLSGKTTTTNSKREEKLFNVTSTPRINTTTNEIFYCTFRGLDPEENHTAELVIPELPLAHPPNER

SEQ ID NO: 1901 - protein, 107 aa, Artificial Sequence
  PD-L1 IgV v67
PKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKV

SEQ ID NO: 1902 - protein, 107 aa, Artificial Sequence
  PD-L1 IgV v75
PKDLYVVEYGSNMTIECKFPVEIQLDLAALIVYWEMEDKNIIQFVHGEEDLKVQHSSYRQRARLLKDQLSLGNAALQITDVKLQDAGVYRCMIGYGGADYKRITVKV

SEQ ID NO: 1903 - protein, 107 aa, Artificial Sequence
  PD-L1 IgV v80
PKDLYVVEYGSNMTIECKFPVEKQLDLAALIVYWEMEDKNIIQFVHGEEVLKVQHSSYRQRARLLKDQLSLGNAALQITDVKLQDAGVYRCLIGYGGADYKRITVKV

SEQ ID NO: 1904 - protein, 107 aa, Artificial Sequence
  PD-L1 IgV v81
PKDLYVVEYGSNMTIECKFPVGKQLDLAALTVYWEMEDKNIIQFVHGEENLKVQHSSYRQRARLLKDQLSLGNAALQITDVKLQDAGVYRCLISYGGADYKRITVEV

SEQ ID NO: 1905 - protein, 107 aa, Artificial Sequence
  PD-L1 IgV v82
PKDLYVVEYGSNMTIECKFPVEKQLDLAALIVYWEMEDKNIIQFVHGEGDLKVQHSSYRQRARLLKDQLSLGNAALQITDVKLQDAGVYRCLIGYGGADYKRITVKV

SEQ ID NO: 1906 - protein, 107 aa, Artificial Sequence
  PD-L1 IgV v87
PKDLYVVEYGSNMTIECKFPVEKQLDLAALSVYWEMEDKNIIQFVHGEEDLKVQHSSYRQRARLLKDQLSLGNAALQITDVKLQDAGVYRCLISYGGADYKRITVKV

SEQ ID NO: 1907 - protein, 107 aa, Artificial Sequence
  PD-L1 IgV v94
PKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVEV

SEQ ID NO: 1908 - protein, 107 aa, Artificial Sequence
  PD-L1 IgV v98
PKDLYVVEYGSNMTIECKFPVEKQLDLAAPSVYWEMEDKNIIQFVHGEEDLKVQHSSYRQRARLLKDQLSLGNAALQITDVKLQDAGVYRCLISYGGADYKRITVEV

SEQ ID NO: 1909 - protein, 107 aa, Artificial Sequence
  PD-L1 IgV v100
PKDLYVVEYGSNTTIECKFPVEKQLDLAALTVYWEMEDKNIIQFVHGEENLKVQHSSYRQRARLLKDQLSLGNAALQITDVKLQDAGVYRCLISYGGADYKRITVEV

SEQ ID NO: 1910 - protein, 107 aa, Artificial Sequence
  PD-L1 IgV v102
PKDLYVVEYGSNMTIECKFPVEKQLDLAALIVYWEMEDKNIIQFVHGEEDLKVQHSSYRQRARLLKDQLSLGNAALQITDVKLQDAGVYRCLIGYGGADYKRITVKV

SEQ ID NO: 1911 - protein, 107 aa, Artificial Sequence
  PD-L1 IgV v103
PKDLYVVEYGSDMTIECKFPVEKQLDLAALIVYWEMEDKNIIQFVHGEEDLKVQHSSYRQRARLLKDQLSLGNAALQITDVKLQDAGVYRCLIGYGGADYKRITVKV

SEQ ID NO: 1912 - protein, 107 aa, Artificial Sequence
  PD-L1 IgV v110
PKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKV

SEQ ID NO: 1913 - protein, 107 aa, Artificial Sequence
  PD-L1 IgV v118
PKDLYVVEYGSNMTIECKFPVEKQLDLAALIVYWEMEDKDIIQFVHGEEDLKDQHSSYRQRARLLKDQLSLGNAALQITDVKLQDAGVYRCMISYGGADYKRITVKV

SEQ ID NO: 1914 - protein, 107 aa, Artificial Sequence
  PD-L1 IgV v127
PKDLYVVEYGSNMTIECKFPVEKQLDLAALIVYWEMEDKDIIQFVHGEEDLKVQHSSYRQRARLLKDQLSLGNAALQITDVKLRDAGVYRCMVSYGGADYKRITVKV

SEQ ID NO: 1915 - protein, 107 aa, Artificial Sequence
  PD-L1 IgV v152
PKDLYVVEYGSNMTIECKFPVEKQLDLAALIVYWEKEGKDIIQFVHGEEDLKVQHSSYSQRARLLKDQLSLGNAALQITDVKLQDAGVYRCMIGYGGADYKRITVKV

SEQ ID NO: 1916 - protein, 114 aa, Artificial Sequence
  PD-L1 IgV v67
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNA

SEQ ID NO: 1917 - protein, 114 aa, Artificial Sequence
  PD-L1 IgV v75
FTVTVPKDLYVVEYGSNMTIECKFPVEIQLDLAALIVYWEMEDKNIIQFVHGEEDLKVQHSSYRQRARLLKDQLSLGNAALQITDVKLQDAGVYRCMIGYGGADYKRITVKVNA

SEQ ID NO: 1918 - protein, 114 aa, Artificial Sequence
  PD-L1 IgV v80
FTVTVPKDLYVVEYGSNMTIECKFPVEKQLDLAALIVYWEMEDKNIIQFVHGEEVLKVQHSSYRQRARLLKDQLSLGNAALQITDVKLQDAGVYRCLIGYGGADYKRITVKVNA

SEQ ID NO: 1919 - protein, 114 aa, Artificial Sequence
  PD-L1 IgV v81
FTVTVPKDLYVVEYGSNMTIECKFPVGKQLDLAALTVYWEMEDKNIIQFVHGEENLKVQHSSYRQRARLLKDQLSLGNAALQITDVKLQDAGVYRCLISYGGADYKRITVEVNA

SEQ ID NO: 1920 - protein, 114 aa, Artificial Sequence
  PD-L1 IgV v82
FTVTVPKDLYVVEYGSNMTIECKFPVEKQLDLAALIVYWEMEDKNIIQFVHGEGDLKVQHSSYRQRARLLKDQLSLGNAALQITDVKLQDAGVYRCLIGYGGADYKRITVKVNA

SEQ ID NO: 1921 - protein, 114 aa, Artificial Sequence
  PD-L1 IgV v87
FTVTVPKDLYVVEYGSNMTIECKFPVEKQLDLAALSVYWEMEDKNIIQFVHGEEDLKVQHSSYRQRARLLKDQLSLGNAALQITDVKLQDAGVYRCLISYGGADYKRITVKVNA

SEQ ID NO: 1922 - protein, 114 aa, Artificial Sequence
  PD-L1 IgV v94
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVEVNA

SEQ ID NO: 1923 - protein, 114 aa, Artificial Sequence
  PD-L1 IgV v98
FTVTVPKDLYVVEYGSNMTIECKFPVEKQLDLAAPSVYWEMEDKNIIQFVHGEEDLKVQHSSYRQRARLLKDQLSLGNAALQITDVKLQDAGVYRCLISYGGADYKRITVEVNA

SEQ ID NO: 1924 - protein, 114 aa, Artificial Sequence
  PD-L1 IgV v100
FTVTVPKDLYVVEYGSNTTIECKFPVEKQLDLAALTVYWEMEDKNIIQFVHGEENLKVQHSSYRQRARLLKDQLSLGNAALQITDVKLQDAGVYRCLISYGGADYKRITVEVNA

SEQ ID NO: 1925 - protein, 114 aa, Artificial Sequence
  PD-L1 IgV v102
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCLIGYGGADYKRITVKVNA

SEQ ID NO: 1926 - protein, 114 aa, Artificial Sequence
  PD-L1 IgV v103
FTVTVPKDLYVVEYGSDMTIECKFPVEKQLDLAALIVYWEMEDKNIIQFVHGEEDLKVQHSSYRQRARLLKDQLSLGNAALQITDVKLQDAGVYRCLIGYGGADYKRITVKVNA

SEQ ID NO: 1927 - protein, 114 aa, Artificial Sequence
  PD-L1 IgV v110
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNA

SEQ ID NO: 1928 - protein, 114 aa, Artificial Sequence
  PD-L1 IgV v118
FTVTVPKDLYVVEYGSNMTIECKFPVEKQLDLAALIVYWEMEDKDIIQFVHGEEDLKDQHSSYRQRARLLKDQLSLGNAALQITDVKLQDAGVYRCMISYGGADYKRITVKVNA

SEQ ID NO: 1929 - protein, 114 aa, Artificial Sequence
  PD-L1 IgV v127
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMVSYGGADYKRITVKVNA

SEQ ID NO: 1930 - protein, 114 aa, Artificial Sequence
  PD-L1 IgV v152
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMIGYGGADYKRITVKVNA

SEQ ID NO: 1931 - protein, 221 aa, Artificial Sequence
  PD-L1 ECD v1
FTVTVPKDLYVVEYGSNMTIECKFPVENQLDLAALIVYWEVEDKTIIQFVNGEEDLEVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1932 - protein, 221 aa, Artificial Sequence
  PD-L1 ECD v2
FTVTVPKDLYVVEYGSNMTLECKFPVEKQLDLAALTVYWEMEDKDITQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1933 - protein, 221 aa, Artificial Sequence
  PD-L1 ECD v3
FTVTVPKDLYVVEYGSNMTLECKFPVEKQLDLAALIVYWEKEDENIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1934 - protein, 221 aa, Artificial Sequence
  PD-L1 ECD v4
FTVTVSKDLYVVEYGSNMTIECKFPVEKQLDLAALIVYWEMEDKTIIQFVHGEEDLKVQHSSYRQRARLLKDQLSLGIAALQTTDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1935 - protein, 221 aa, Artificial Sequence
  PD-L1 ECD v5
FTVTVPKDLYVVEYGSNMTIECKFPVEKQLDLAALIVYWEMEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1936 - protein, 221 aa, Artificial Sequence
  PD-L1 ECD v6
FTVTVPKDLYVVEYGSNMTIECKFPVEKQLDLAALIVYWEKEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1937 - protein, 221 aa, Artificial Sequence
  PD-L1 ECD v7
FTVTVPKDLYVVEYGSNMTIECKFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1938 - protein, 221 aa, Artificial Sequence
  PD-L1 ECD v8
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1939 - protein, 221 aa, Artificial Sequence
  PD-L1 ECD v9
FTVTVPKDLYVVEYGSNMTIECKFPVEKQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1940 - protein, 221 aa, Artificial Sequence
  PD-L1 ECD v10
FTVTVPKDLYVVEYGSNMTIECKFPVEKQLDLAALIVYWEKEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1941 - protein, 221 aa, Artificial Sequence
  PD-L1 ECD v11
FTVTVPKDLYVVEYGSNMTLECKFPVEKQLDLAALTVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1942 - protein, 221 aa, Artificial Sequence
  PD-L1 ECD v12
FTVTVPKDLYVVEYGSDMTIECKFPVEKQLDLAALIVYWEMEDKTIIQFAHGEEDLKVQHSSYRQRARLLKGQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1943 - protein, 221 aa, Artificial Sequence
  PD-L1 ECD v13
FTVTVPKDLYVVEYGSNMTLECKFPVEKQLDLAALIVYWEMEDKNIIQSVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1944 - protein, 221 aa, Artificial Sequence
  PD-L1 ECD v14
FTVTVPKDLYVVEYGSNMTIECKFPVEKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1945 - protein, 221 aa, Artificial Sequence
  PD-L1 ECD v15
FTVTVPKDLYVVEYGSNMTLECKFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1946 - protein, 221 aa, Artificial Sequence
  PD-L1 ECD v16
FTVTVPKDLYVVEYGSNMTLECKFPVEKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1947 - protein, 221 aa, Artificial Sequence
  PD-L1 ECD v17
FTVTVPKDLYVVEYGSNMTIECKFPVEKQLDLAALIVYWEVEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1948 - protein, 221 aa, Artificial Sequence
  PD-L1 ECD v18
FTVTVPKDLYVVEYGSNMTIECKFPVEKQLDLAALIVYWEKEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1949 - protein, 221 aa, Artificial Sequence
  PD-L1 ECD v19
FTVTVPKDLYVVEYGSNMTIECKFPVEKQLDLDALIVYWEMEDKNIIQFVHGEEDLKVQHSSYRQRARLLKDQLPLGNAALQITEVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1950 - protein, 221 aa, Artificial Sequence
  PD-L1 ECD v20
FTVTVPKDLYVVEYGSNITIECKFPVEKQLDLAALIVYWEKEGKNIIQFVRGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1951 - protein, 221 aa, Artificial Sequence
  PD-L1 ECD v21
FTVTVPKDLYEVEYGSNMTLECKFPVEKQLDLAALTVYWEMEDKDIIQFVHGEEDLKVQRSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1952 - protein, 221 aa, Artificial Sequence
  PD-L1 ECD v22
FTVTVPKDLYVVEYGSNMTIECKFPVEKQLDLDALIVYWEMEDKNIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1953 - protein, 221 aa, Artificial Sequence
  PD-L1 ECD v23
FTVTVPKDLYVVEYGGNMTIECKFPVEKQLDLDALIVYWEMEDKNIIQFVHGEEDLKVQHSSYRQRARLLEDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1954 - protein, 221 aa, Artificial Sequence
  PD-L1 ECD v24
FTVTVPKDLYVVEYGSNMTIECKFPVGKQLDLAALIVYWEMEDKTIIQFVHGEEDLKVQHSSYRQRARLLKDQLSLGNAALQITDVKLQDAGVYRCIISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1955 - protein, 221 aa, Artificial Sequence
  PD-L1 ECD v25
FTVTVPKDLYVVEYGSNMTIECKFPVGKQLDLAALIVYWEMEDKTIIQFVHGEEDLRVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1956 - protein, 221 aa, Artificial Sequence
  PD-L1 ECD v26
FTVTVPKDLYVVEYGSNMTIECKFPVEKQLDLDALIVYWEMEDKNIIQFVHGVEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1957 - protein, 221 aa, Artificial Sequence
  PD-L1 ECD v27
FTVTVPKDLYVVEYGSNMTIECKFPVEKQLDLAALIVYWEMEGKDIIQFVHGEEDLKAQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1958 - protein, 221 aa, Artificial Sequence
  PD-L1 ECD v28
FTVTVPKDLYVVEYGSNMTIECKFPVEKQLDLAALIVYWGMEVKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1959 - protein, 221 aa, Artificial Sequence
  PD-L1 ECD v29
FTVTVPKDLYVVESGSNMTIECKFPVEEQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1960 - protein, 221 aa, Artificial Sequence
  PD-L1 ECD v30
FTVTVPKDLYVVEYGSNMTIECKFPVEKQLDLDALIVYWEMEDKNIIQFVHGEEDLKVQHSSYRQRARLLKDQLSLGSAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1961 - protein, 221 aa, Artificial Sequence
  PD-L1 ECD v31
FTVTVPKDLYVVEYGSNMTIECKFPVEKQLDLDALIVYWEMEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1962 - protein, 221 aa, Artificial Sequence
  PD-L1 ECD v32
FTVTVPKDLYVVEYGSNMTIECKFPVEKQLDLDALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1963 - protein, 221 aa, Artificial Sequence
  PD-L1 ECD v33
FTVTVPKDLYVVEYGSNMTIECKFPVEKQLDLDALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1964 - protein, 221 aa, Artificial Sequence
  PD-L1 ECD v34
FTVTVPKDLYVVEYGSNMTIECKFPVGKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1965 - protein, 221 aa, Artificial Sequence
  PD-L1 ECD v35
FTVTVPKDLYVVEYGSNMTIECKFPVEKQLDLAALIVYWEMEDKTIIQFAHGEEDLKVQHSSYRQRARLLKDQLSLGSAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1966 - protein, 221 aa, Artificial Sequence
  PD-L1 ECD v36
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITMKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1967 - protein, 221 aa, Artificial Sequence
  PD-L1 ECD v37
FTVTVPKDLYVVEYGSNMTLECKFPVEKQLDLAALTVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1968 - protein, 221 aa, Artificial Sequence
  PD-L1 ECD v38
FTVTVPKDLYVVEYGSNMTIECKFPVEKQLDLAALIVYWEMEDKTIIQFVHGEEDLKVQHSSYRQRARLLKDQPPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1969 - protein, 221 aa, Artificial Sequence
  PD-L1 ECD v39
FTVTVPKDLYVVEYGSNMTIECKFPVEKQLDLAALIVYWEMEDKTIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1970 - protein, 221 aa, Artificial Sequence
  PD-L1 ECD v40
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYRRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1971 - protein, 221 aa, Artificial Sequence
  PD-L1 ECD v41
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1972 - protein, 221 aa, Artificial Sequence
  PD-L1 ECD v42
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCVISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1973 - protein, 221 aa, Artificial Sequence
  PD-L1 ECD v43
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGAGYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1974 - protein, 221 aa, Artificial Sequence
  PD-L1 ECD v44
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1975 - protein, 221 aa, Artificial Sequence
  PD-L1 ECD v45
FTVTVPKDLYVVEYGSNMTLECKFPVGKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1976 - protein, 221 aa, Artificial Sequence
  PD-L1 ECD v46
FTVTVPKDLYVVEYGSNMTLECKFPVGKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1977 - protein, 221 aa, Artificial Sequence
  PD-L1 ECD v47
FTVTVPKDLYVVEYGSNMTLECKFPVEKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1978 - protein, 221 aa, Artificial Sequence
  PD-L1 ECD v48
FTVTVPKDLYVVEYGSNMTLECKFPVEKQLDLDALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1979 - protein, 221 aa, Artificial Sequence
  PD-L1 ECD v49
FTVTVPKDLYVVEYGSNMTLECKFPVEKQLDLAALIVYWEMEGKDIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1980 - protein, 221 aa, Artificial Sequence
  PD-L1 ECD v50
FTVTVPKDLYVVEYGSNMTIECKFPVGKQLDLAALIVYWEMEDKTIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1981 - protein, 221 aa, Artificial Sequence
  PD-L1 ECD v51
FTVTVPKDLYVVEYGSNMTIECKFPVEKQLDLAALIVYWEMEDKTIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1982 - protein, 221 aa, Artificial Sequence
  PD-L1 ECD v52
FTVTVPKDLYAVEYGSNMTLECKFPVGKQLDLAALIVYWEMEGKDIIQFVYGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1983 - protein, 221 aa, Artificial Sequence
  PD-L1 ECD v53
FTVTVPKDLYVVEYGSNMTLECKFPVGKQLDLAALIVYWEMEGKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1984 - protein, 221 aa, Artificial Sequence
  PD-L1 ECD v54
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1985 - protein, 221 aa, Artificial Sequence; identical to SEQ ID NO: 1941
  PD-L1 ECD v55

SEQ ID NO: 1986 - protein, 221 aa, Artificial Sequence
  PD-L1 ECD v56
FTVTVPKDLYVVEYGSNMTLECKFPVEEQLDLAALIVYWEMEGKDIIQFVHGGEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1987 - protein, 221 aa, Artificial Sequence
  PD-L1 ECD v57
FTVTVPKDLYVVEYGSNMTIECKFPVEKQLDLDALIVYWEMEGKDIIQFVHGEEDLKAQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1988 - protein, 221 aa, Artificial Sequence
  PD-L1 ECD v58
FTVTVPKDLYVVEYGSNMTIECRFPVEKQLDLAALIVYWEMEGKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1989 - protein, 221 aa, Artificial Sequence
  PD-L1 ECD v59
FTVTVPKDLYVVEYGSNMTLECKFPVEKQLDLAALIVYWEMEGKDIIQFVHGEEDLKAQHSSYRQRARLLKDQLSLGIAALQITDVKLQGAGVYRCMISYDGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1990 - protein, 222 aa, Artificial Sequence
  PD-L1 ECD v60
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1991 - protein, 221 aa, Artificial Sequence
  PD-L1 ECD v61
FTVTVPKDLYVVEYGSNMTLECEFPVEKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1992 - protein, 221 aa, Artificial Sequence
  PD-L1 ECD v62
FTVTVPKDLYVVEYGSNMTLECEFPVEKQLDLAALIVYWEMEGKDIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1993 - protein, 221 aa, Artificial Sequence
  PD-L1 ECD v63
FTVTVPKDLYVVEYGSNMIIECKFPVGKQLDLAALIVYWEMEDKIIIQFAHGEEDLKVQHSSYRQRARLLKDQLSLGIAALQITDVKLQDAGVYRCKISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1994 - protein, 221 aa, Artificial Sequence
  PD-L1 ECD v64
FTVTVPKDLYVVEYGSNMTLECKFPVEKQLDLAALIVYWEKEGKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1995 - protein, 221 aa, Artificial Sequence
  PD-L1 ECD v65
FTVTVPKDLYVVEYGSNMTIECRFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1996 - protein, 227 aa, Artificial Sequence
  PD-L1 ECD v66
CHECKFTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1997 - protein, 68 aa, Artificial Sequence
  CD8 hinge and transmembrane domain
KPTTTPAPRPPTPAPTIASQPLSLRPEACRPAAGGAVHTRGLDFACDIYIWAPLAGTCGVLLLSLVIT

SEQ ID NO: 1998 - protein, 431 aa, Artificial Sequence
  antiCD19 chimeric antigen receptor CAR-2
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1999 - protein, 707 aa, Artificial Sequence
  antiCD19 chimeric antigen receptor CAR-2
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPSRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 2000 - DNA, 8708 bp, Artificial Sequence
  anti-CD19 chimeric antigen receptor CAR-2
agcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacaataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgatcacgagactagcctcgagaagcttgatatcgaattcccacggggttggacgcgtaggaacagagaaacaggagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatcgcctggagacgccatccacgctgttttgacttccatagaaggatcccctgcaggtaatacgactcactatagggtccactgccgccaccatggctctgcctgtgacagctctgctgctgcctctggccctgctgctccatgccgccagacccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcgccaagcccaccacgacgccagcgccgcgaccaccaacaccggcgcccaccatcgcgtcgcagcccctgtccctgcgcccagaggcgagccggccagcggcggggggcgcagtgcacacgagggggctggacttcgccagtgatatctacatctgggcgcccctggccgggacttgtggggtccttctcctgtcactggttatcaccctttactgcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagtggcgagggcagaggaagtctgctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccagttccgcccattctccgccccatggctgactaattttttttatttatgcagaggccgaggccgcctcggcctctgagctattccagaagtagtgaggaggcttttttggaggcctaggcttttgcgtcgagacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgca

SEQ ID NO: 2001 - protein, 428 aa, Artificial Sequence
  antiCD19 chimeric antigen receptor CAR-1
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2002 - protein, 706 aa, Artificial Sequence
  antiCD19 chimeric antigen receptor CAR-1
MALPVTALLLPLALLLHAARPGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGRSGEGRGSLLTCGDVEENPGPSRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLWEAFTETLYPADGGLEGRNDMALKLVGGSHLIANIKTTYRSKKPAKNLKMPGVYYVDYRLERIKEANNETYVEQHEVAARYCDLPSKLGHKLN

SEQ ID NO: 2003 - protein, 232 aa, Artificial Sequence
  Blue fluorescent protein
SRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLWEAFTETLYPADGGLEGRNDMALKLVGGSHLIANIKTTYRSKKPAKNLKMPGVYYVDYRLERIKEANNETYVEQHEVAARYCDLPSKLGHKLN

SEQ ID NO: 2004 - protein, 18 aa, Artificial Sequence
  T2A
EGRGSLLTCGDVEENPGP

SEQ ID NO: 2005 - protein, 248 aa, Artificial Sequence
  Anti-CD19 scFv
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAA

SEQ ID NO: 2006 - DNA, 1356 bp, Artificial Sequence
  anti-CD19 chimeric antigen receptor nucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggactaagttggaaataacaggctccacctctggatccggcaagcccggatctggcgagggatccaccaagggcgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcagcggccgcaaagcccaccacgacgccagcgccgcgaccaccaacaccggcgcccaccatcgcgtcgcagcccctgtccctgcgcccagaggcgagccggccagcggcggggggcgcagtgcacacgagggggctggacttcgccagtgatatctacatctgggcgcccctggccgggacttgtggggtccttctcctgtcactggttatcaccctttactgcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 2007 - DNA, 63 bp, Artificial Sequence
  T2A Nucleotide
ggcagtggcgagggcagaggaagtctgctaacatgcggtgacgtcgaggagaatcctggccca

SEQ ID NO: 2008 - protein, 21 aa, Artificial Sequence
  T2A Protein
GSGEGRGSLLTCGDVEENPGP

SEQ ID NO: 2009 - protein, 208 aa, Artificial Sequence
  CD80 v196 ECD
VIHVTKEVKEVATLSCGHNVSVEELEQTRIYWRKDKKMVLTMMSGDLNIWPEYKNRTIFDITNNLSIVILALRPSDEGTYECVVQEYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2010 - protein, 208 aa, Artificial Sequence
  CD80 v197 ECD
VIHVTKEVKEVATLSCGHNVSVEELEQTRIYWRKDKKMVLTMMSGDLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2011 - protein, 208 aa, Artificial Sequence
  CD80 v198 ECD
VIHVTKEVKEVATLSCGHNVSVEELAQTRIYWQKDKKMVLTMMSGDLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2012 - protein, 208 aa, Artificial Sequence
  CD80 v199 ECD
VIHVTKEVKEVATLSCGHNVSVEELEQTRIYWLKDKKMVLTMMSGDLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2013 - protein, 208 aa, Artificial Sequence
  CD80 v200 ECD
VIHVTKEVKEVATLSCGHNVSVEELEQTRIYWLKDKKMVLTMMSGDLNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2014 - protein, 208 aa, Artificial Sequence
  CD80 v201 ECD
VIHVTKEVKEVATLSCGYNVSVEELEQTRIYWLKDKKMVLTMMSGDLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2015 - protein, 208 aa, Artificial Sequence
  CD80 v202 ECD
VIHVTKEVKEVATLSCGHNVSVEELAQTRIYWLKDKKMVLTMMSGDINIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2016 - protein, 208 aa, Artificial Sequence
  CD80 v203 ECD
VIHVTKEVKEVATLSCGYNVSVEELAQTRIYWLKDKKMVLTMMSGDINIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2017 - protein, 208 aa, Artificial Sequence
  CD80 v204 ECD
VIHVTKEVKEVATLSCGHNVSVEELAQTRIYWLKDKKMVLTMMSGEINIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2018 - protein, 208 aa, Artificial Sequence
  CD80 v205 ECD
VIHVTKEVKEVATLSCGHNVSVEELAQTRIYWRKDKKMVLTMMSGEINIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2019 - protein, 208 aa, Artificial Sequence
  CD80 v206 ECD
VIHVTKEVKEVATLSCGYNVSVEELAQTRIYWQKDKKMVLTMMSGDLNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2020 - protein, 208 aa, Artificial Sequence
  CD80 v207 ECD
VIHVTKEVKEVATLSCGHNVSVEELAQTRIYWLKDKKMVLTMMSGDVNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2021 - protein, 208 aa, Artificial Sequence
  CD80 v208 ECD
VIHVTKEVKEVATLSCGHNVSVEELAQTRIYWLKDKKMVLTMMSGDVNIWPEYKNRTIFDITNNLSIVILALRPSDEGAYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2022 - protein, 208 aa, Artificial Sequence
  CD80 v209 ECD
VIHVTKEVKEVATLSCGHNVSVEELAQTRIYWLKDKKMVLSMMSGDVNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2023 - protein, 208 aa, Artificial Sequence
  CD80 v210 ECD
VIHVTKEVKEVATLSCGHNVSVEELAQTRIYWLKDKKMVLTMMSGDINIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2024 - protein, 208 aa, Artificial Sequence
  CD80 v211 ECD
VIHVTKEVKEVATLSCGHNVSVEELAQTRIYWLKDKKMVLTMMSGDINIWPEYKNRTIFDINNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2025 - protein, 208 aa, Artificial Sequence
  CD80 v212 ECD
VIHVTKEVKEVATLSCGHNVSVEELAQTRIYWLKDKKMVLTMMSGDVNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2026 - protein, 208 aa, Artificial Sequence
  CD80 v213 ECD
VIHVTKEVKEVATLSCGHNVSVEELEQTRIYWQKDKKMVLTMTSGDLNIWPEYKNRTIFDITNNLSIVILALRPSDEGTYECVVQKYEKDAFKQEHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2027 - protein, 208 aa, Artificial Sequence
  CD80 v214 ECD
VIHVTKEVKEVATLSCGHNVSVEELAQTRIYWRKDKEMVLTMMSGDVNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2028 - protein, 208 aa, Artificial Sequence
  CD80 v215 ECD
VIHVTKEVKEVATLSCGHNVSADELAQTRIYWLKDKKMVLTMMSGDVNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2029 - protein, 208 aa, Artificial Sequence
  CD80 v216 ECD
VIHVTKEVKEVATLSCGHNVSVEDLAQTRIYWLKDKKMVLTMMSGDVNIWPEYRNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2030 - protein, 208 aa, Artificial Sequence
  CD80 v217 ECD
VIHVTKEVKEVATLPCGHNVSVEELAQTRIYWLKDKKMVLTMMSGDLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2031 - protein, 208 aa, Artificial Sequence
  CD80 v218 ECD
VIHVTKDVKEVATLSCGHNVSVEELAQTRIYWQKDKKMVLTMMSGDINIWPEYKNRTIFDITNNLSIVILALRPSDEGTYECVVLKYEKDAFKREHQAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2032 - protein, 208 aa, Artificial Sequence
  CD80 v219 ECD
VIHVTKEVKEVATLSCGHNVSVEELAQTRIYWLKDKKMVLSMISGDMNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2033 - protein, 208 aa, Artificial Sequence
  CD80 v220 ECD
VIHVTKEVKEVATLSCGHNVSVEELAQTRIYWQKDKKMVLTMMSGDINIWPEYRNRTIFDITNNLSIVILALRPSDEGTYECVVEKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2034 - protein, 208 aa, Artificial Sequence
  CD80 v221 ECD
VIHVTKEVKEVATLSCGHNVSVEELAQTRIYWKKDKKMVLTMMSGVMNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2035 - protein, 208 aa, Artificial Sequence
  CD80 v222 ECD
VIHVTKEVKEVATLSCGHNVSVEELAQTRISWQKDKKMVLTMMSGDLNIWPEYKNRTIFDITNNLSIVILALRPSDEGLYECVVLKYGKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2036 - protein, 208 aa, Artificial Sequence
  CD80 v223 ECD
VIHVTKEVKEVATLSCGLNVSAEELAQTRIYWQKDKKMVLTMMSGDLTIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2037 - protein, 208 aa, Artificial Sequence
  CD80 v224 ECD
VIHVTKEVKEVATLSCGHNVSVEELAHTRIYWQKDKKMVLTMMSGDLNIWPEYKNRTIFDITNNLSIVILALRPSDEGTYECVVQKYEKDAFKQKHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2038 - protein, 208 aa, Artificial Sequence
  CD80 v225 ECD
VIHVTKEVKEVATLSCGHNVSVEELAQTRIYWKKDKKMVLTMMSGDVNIWPEYKNRTIFDITNNLSIVILALRPSDEGTYECVVLKYEEDAFRREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2039 - protein, 208 aa, Artificial Sequence
  CD80 v226 ECD
VIHVTKEVKEVATLSCGHNVSVEELAQTRIYWQKDKKMVLTMMSGDINIWPEYKNRTIFDITNNLSIVILALRPSDAGTYECVVQKYEKDAFKWEHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2040 - protein, 208 aa, Artificial Sequence
  CD80 v227 ECD
VIHVTKEVKEVATLSCGHNVSVEELEQTRIYWQKDKKMVLTMISGDLNIWPEYKNRTIFDITNNLSIVILALRPSDEGTYECVVQEYEKDAFKWEHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2041 - protein, 208 aa, Artificial Sequence
  CD80 v228 ECD
VIHVTKEVKEVATLSCGHNVSVEELAHTRIYWLKDKKMVLTMMSGDVNIWPEYKDRTIFDITNNLSIVILALRPSDEGTYECVVQKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2042 - protein, 208 aa, Artificial Sequence
  CD80 v229 ECD
VIHVTKEVKEVATLSCGYNASVEELAQTRIYWLKDKKMVLTMMSGDVNIWPEFKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2043 - protein, 208 aa, Artificial Sequence
  CD80 v230 ECD
VIHVTKEVKEVATLSCGHNVSAEELAQTRIYWQKDKKMVLTMMSGDMNIWPEYKNRTIFDITNNLSIEILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2044 - protein, 208 aa, Artificial Sequence
  CD80 v231 ECD
VIHVTKEVKEVATLSCGHNVSVEELAQTRIYWLKDKKMVLTMMSGDLNIWPEYKNRTIFDITNNLSIVILGLRPSDEGTYECVVLKYEKDASKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2045 - protein, 208 aa, Artificial Sequence
  CD80 v232 ECD
VIHVTKEVKEVATLSCGHNVSAEELAQTHIYWQKDKKMVLTMMSGEINIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2046 - protein, 208 aa, Artificial Sequence
  CD80 v233 ECD
VIHVTKEVKEVATLSCGHNVSVEELAQTRIYWLKDKKMVLTMISGDMNIWPEYKNRTIFDITNNLSIVILALRPSDEGTYECVVQKYEKDAFKWEHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2047 - protein, 208 aa, Artificial Sequence
  CD80 v234 ECD
VIHVTKEVKEVATLSCGYNVSVEELAQTRIYWQKDKKMVLTMMSGDMNIWPEYKNRTIFDITNNLSIMILALRPSDEGTYECVVLKYEKDAFKREHQAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2048 - protein, 208 aa, Artificial Sequence
  CD80 v235 ECD
VIHVTKEVKEVATLSCGHNVSVEELAQTRIYWLKDKKMVLTMMSGDLNIWPEYKNRTIFDITNNLSIMILALRPSDEGTYECVVQKYDKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2049 - protein, 208 aa, Artificial Sequence
  CD80 v236 ECD
VIHVTKEVKEVATLSCGHNVSVEELAQTRIYWLKDKKMVLTMVSGDINIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2050 - protein, 208 aa, Artificial Sequence
  CD80 v237 ECD
VIHVTKEVKEVATLSCGHNVSVEELAQTRIYWQKDKKMVLTMMSGDLNIWPEYKNRTIFDITNNLSIVILGLRPSDEGTYECVVLKYEKDAFKREHQAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2051 - protein, 208 aa, Artificial Sequence
  CD80 v238 ECD
VIHVTKEVKEVATLSCGHNVSVEELAQTRIYWQKDKKMVLTMMSGDVNIWPEYKNRTIFDITNNLSIVILGLRPSDEGTYECVVMKYEKDAFKREHQAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2052 - protein, 208 aa, Artificial Sequence
  CD80 v239 ECD
VIHVTKEVKEVATLSCGYNVSVEELAQTRIHWQKDKKMVLTMMSGDVNIWPEYKNRTIFDITNNLSIVILGLRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2053 - protein, 208 aa, Artificial Sequence
  CD80 v240 ECD
VIHVTKEVKEVATLSCGHNVSVEELAQTRIYWQKDKKMVLTMMSGEVNIWPEYKNRTIFDITNNLSIVILALRPSDEGTYECVVLKYEKDAFKREHQAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2054 - protein, 208 aa, Artificial Sequence
  CD80 v241 ECD
VIHVTKEVKEVATLSCGHNVSVEELAQTRIYWQKDKKMVLTMMSGVINIWPEYKNRTIFDITNNLSIVILGLRPSDEGTYECVVLKYEKDAVKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2055 - protein, 208 aa, Artificial Sequence
  CD80 v242 ECD
VIHVTKEVKEVATLSCGHNVSVEELAQTRIYWQKDKKMVLTMMSGDVNIWPEYKNRTIFDIANNLSIVILGLRPSDEGTYECAVLKHEKDAFKREHMAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2056 - protein, 208 aa, Artificial Sequence
  CD80 v243 ECD
VIHVTKEVKEVATLSCGHNVSVEELAQTRIYWLKDKKMVLTMMSGDMKIWPEYKNRTIFDITNNLSIVILALRPSDEGTYECVVQKYEKDAFKREHQAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2057 - protein, 208 aa, Artificial Sequence
  CD80 v244 ECD
VIHVTKEVKEVATLSCGHNVSVEELAQTRIYWQKDKKMVLTMMSGDMNIWPEYKNRTIFDITNNLSIVILALRPSDEGTYECVVQKYEKDAFTRVHQAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2058 - protein, 208 aa, Artificial Sequence
  CD80 v245 ECD
VIHVTKEVKEVATLSCGHNVSVEELAQTRIYWQKDKKMVLTMMSGDVKIWPEYKNRTIFDITNNLSIMILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2059 - protein, 208 aa, Artificial Sequence
  CD80 v246 ECD
VIHVTKEVKEVATLSCGHNVSVEELAQTRIYWLKDKKMVLTMMSGDIDIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2060 - protein, 208 aa, Artificial Sequence
  CD80 v247 ECD
VIHVTKEVKEVATLSCGHNVSVEELAQTHIYWQKDKKMVLTMVSGDINVWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2061 - protein, 208 aa, Artificial Sequence
  CD80 v248 ECD
VIHVTKEVKEVATLSCGHNVSVEELAHTRIYWQKDKKMVLTMMSGDINIWPEYKNRTIFDITNNLSIVILALRPSDEGTYECVVQKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2062 - protein, 208 aa, Artificial Sequence
  CD80 v249 ECD
VIHVTKEVKEVATLSCGHNVSVEELAQTRIYWQKDKKMVLTMMSGDINIWPEYKNRTIFDITNNLSIVILALRPSDEGTYECVVQKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2063 - protein, 208 aa, Artificial Sequence
  CD80 v250 ECD
VIHVTKEVKEVATLSCGHNVSVEELAQTRIYWQKDKKMVLTMMSGDINIWPEYKNRTIFDISNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2064 - protein, 208 aa, Artificial Sequence
  CD80 v251 ECD
VIHVTKEVKEVATLSCGHNVSVEELEQTRIYWQKDKKMVLTMMSGDLNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2065 - protein, 208 aa, Artificial Sequence
  CD80 v252 ECD
VIHVTKEVKEVATLSCGHNVSVEELAQTRIYWQKDKKMVLTMMSGDINIWPEYKNRTIFDITNNLSIVILALRPSDEGTYECVVLKQEEDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2066 - protein, 208 aa, Artificial Sequence
  CD80 v253 ECD
VIHVTKEVKEVATLSCGHNVSAEELAQTRIYWQKDKKMVLTMMSGDINIWPEYKNRTIFDITNNLSIVILALRPSDEGTYECVVLKNEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2067 - protein, 208 aa, Artificial Sequence
  CD80 v254 ECD
VIHVTKEVKEVATLSCGYNVSVEELEQTRIYWQKDKKMVLTMMSGDLNIWPEYKNRTIFDITNNLSIVILALRPSDEGTYECVVQKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2068 - protein, 208 aa, Artificial Sequence
  CD80 v255 ECD
VIHVTKEVKEVATLSCGHNVSVEELAQTRIYWQKDKKMVLTMMSGDLNIWPEYKNRTIFDITNNLSIVILGLRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2069 - protein, 208 aa, Artificial Sequence
  CD80 v256 ECD
VIHVTKEVKEVATLSCGHNVSVEELAQTRIYWQKDKKMVLTMMSGDVNIWPEYKNRTIFDITNNLSIVILGLRPSDEGTYECVVLKYDKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2070 - protein, 208 aa, Artificial Sequence
  CD80 v257 ECD
VIHVTKEVKEVATLSCGHNVSVEELAQTRIYWQKDKKMVLTMMSGDMNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2071 - protein, 208 aa, Artificial Sequence
  CD80 v258 ECD
VIHVTKEVKEVATLSCGHNVSVEELAQTRIYWQKDKKMVLTMMSGDVNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2072 - protein, 208 aa, Artificial Sequence
  CD80 v259 ECD
VIHVTKEVKEVATLSCGHNVSVEELAQTRVYWQKDKKMVLTMMSGDVNIWPEYKNRTIFDITNNLSIVILGLRPSDEGTYECVVLKYEKDVFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2073 - protein, 208 aa, Artificial Sequence
  CD80 v260 ECD
VIHVTKEVKEVATLSCGHNVSVEELAQTRVCWQKDKKMVLTMMSGDVNIWPEYKNRTIFDITNNLSIVILGLRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2074 - protein, 208 aa, Artificial Sequence
  CD80 v261 ECD
VIHVTKEVKEVATLSCGHNVSDEELAQTRIYWQKDKKMVLTMMSGDLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2075 - protein, 208 aa, Artificial Sequence
  CD80 v262 ECD
VIHVTKEVKEVATLSCGYNVSVEELAQTRIYWQKDKKMVLTMMSGDMKIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2076 - protein, 208 aa, Artificial Sequence
  CD80 v263 ECD
VIHVTKEVKEVATLSCGHNVSVEELAQTRIYWQKDKKMVLSMMSGDVNIWPEYKNRTIFDITNNLSIVILGLRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2077 - protein, 208 aa, Artificial Sequence
  CD80 v264 ECD
VIHVTKEVKEVATLSCGHNVSVEELAQTRIYWQKDKKMVLTMMSGDVTIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2078 - protein, 208 aa, Artificial Sequence
  CD80 v265 ECD
VIHVTKEVKEVATLSCGHNVSVEELAQTRIYWQKDKKMVLTMMSGEVNIWPEYKNRTIFDITNNLSIVILDLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2079 - protein, 208 aa, Artificial Sequence
  CD80 v266 ECD
VIHVTKEVKEVATLSCGHNVSVEELAQTRIYWQKDKKMVLTMMSGEVNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2080 - protein, 208 aa, Artificial Sequence
  CD80 v267 ECD
VIHVTKEVKEVATLSCGHNVSVEELAQTRIYWQKDKKMVLSMISGDMNIWPEYKNRTIFDITNNLSIVILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2081 - protein, 208 aa, Artificial Sequence
  CD80 v268 ECD
VIHVTKEVKEVATLSCGHNVSVEELAQTRIYWQKDKKMVLSMISGDVNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2082 - protein, 208 aa, Artificial Sequence
  CD80 v269 ECD
VIHVTKEVKEVATLSCGHNVSVEELAQTRIYWQKDKKMVLSMISGDLNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2083 - protein, 208 aa, Artificial Sequence
  CD80 v270 ECD
VIHVTKEVKEVATLSCGYNVSAEELAQTRIYWQKDKKMVLTMMSGDVNIWPEYKNRTIFDISNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2084 - protein, 208 aa, Artificial Sequence
  CD80 v271 ECD
VIHVTKEVKEVATLSCGYNVSVEELEQTRIYWQKDKKMVLTMMSGDLNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2085 - protein, 208 aa, Artificial Sequence
  CD80 v272 ECD
VIHVTKEVKEVATLSCGHNVSVEELAQTRIYWQKDKEMVLTMMSGDVDIWPEYKNRTIFDITNNLSIVILALRPSDEGTYECVVQKYEKNAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2086 - protein, 208 aa, Artificial Sequence
  CD80 v273 ECD
VIHVTKEVKEVATLSCGHNVSVEELAHTRIYWQKDKKMVLTMMSGVLNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2087 - protein, 208 aa, Artificial Sequence
  CD80 v274 ECD
VIHVTKEVKEVATLSCGHNVSLEELAHTRIYWQKDKKMVLTMMSGDINIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2088 - protein, 208 aa, Artificial Sequence
  CD80 v275 ECD
VIHVTKEVKEVATLSCGHNVSVEELAQTRIYWQKDKKMVLTMMSGVLNIWPEYKNRTIFDITNNLSIMILALRPSDEGTYECVVQKYDKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2089 - protein, 208 aa, Artificial Sequence
  CD80 v276 ECD
VIHVTKEVKEVATLSCGHNVSVEELAQTRIYWQKDKKMVLSMVSGDINIWPEYKNRTIFDITNNLSIVIMGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2090 - protein, 208 aa, Artificial Sequence
  CD80 v277 ECD
VIHVTKEVKEVATLSCGHNVSVEELAQTRIYWQKDKKMVLTMMSGEVNIWPEYKNRTIFDITDNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2091 - protein, 208 aa, Artificial Sequence
  CD80 v278 ECD
VIHVTKEVKEVATLSCGHNVSVEELAQTRIYWQKDKKMVLTMMSGDVNIWPEYKNRTIFDIANNLSIVILDLRPSDEGTYECVVLKYEKDAFEREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2092 - protein, 208 aa, Artificial Sequence
  CD80 v279 ECD
VIHVTKEVKEVATLSCGHNVSVEELAQTRIYWQKDKKMVLTMMSGEVNIWPEYKNRTIFDITNNLSIMILALRPSDEGTYECVVLKYEKGAFEREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2093 - protein, 208 aa, Artificial Sequence
  CD80 v280 ECD
VIHVTKEVKEVATLSCGHNVSVEELAQTRIYWQKDKKMVLTMISGDVNIWPEYKNRTIFDITNNLSIVILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2094 - protein, 208 aa, Artificial Sequence
  CD80 v281 ECD
VIHVTKEVKEVATLSCGHNVSVEELAQTRIYWQKDKKMVLTMMSGDLNIWPEYKNRTIFDITNNLSIVILGLRPSDEGTYECVVMKYEKDAYKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2095 - protein, 208 aa, Artificial Sequence
  CD80 v282 ECD
VIHVTKEVKEVATLSCGHNVSVEELAQTRIYWQKDKKMVLTVMSGDVNIWPDYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2096 - protein, 208 aa, Artificial Sequence
  CD80 v283 ECD
VIHVTKEVKEVATLSCGHNVSDEELAQTRIYWQKDKKMVLTMMSGDLNIWPEYKNRTIFDITNNLSIVIMALRPSDEGTYECVVLKYEKDAFKREHQAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2097 - protein, 208 aa, Artificial Sequence
  CD80 v284 ECD
VIHVTKEVKEVATLSCGHNVSVEELAQTRIYWQKDKKMVLSMMSGDVNIWPEYKNRTIFDITNNLSIVILALRPSDEGTYECVVLKYEKDAFKREHQAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2098 - protein, 208 aa, Artificial Sequence
  CD80 v285 ECD
VIHVTKEVKEVATLSCGHNVSVEELAQTRIYWQKDKKMVLTMMSGDMNIWPEHKNRTIFDITNNLSIVILGLRPSDEGTYECVVLKYEKGAFKREHRAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2099 - protein, 208 aa, Artificial Sequence
  CD80 v286 ECD
VIHVTKEVKEVATLSCGHNVSVEELAQTRIYWQKDKKMVLTMMSGDMNIWPEYKNRTIFDITNNLSIVILDVHPSDEGTYKCVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2100 - protein, 208 aa, Artificial Sequence
  CD80 v287 ECD
VIHVTKEVKEVATLSCGHNVSVEELAQTRIYWLKDKKMVLTMISGDMNIWPEFKNRTIFDISNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2101 - protein, 208 aa, Artificial Sequence
  CD80 v288 ECD
VIHVTKEVKEVATLSCGHNVSVEELAQTRIYWQKDKKTVLTMMSGEVSIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2102 - protein, 208 aa, Artificial Sequence
  CD80 v289 ECD
VIHVTKEVKEVATLSCGHNVSVEELAQTRIYWRKDKKMVLTMMSGDVKIWPEYKNRTIFDITNNLSIVILALRPSDEGTYECVVMKYEKDALKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2103 - protein, 208 aa, Artificial Sequence
  CD80 v290 ECD
VIHVTKEVKEVATLSCGHNVSVEELAQTRIYWQKDKKTVLTMVSGDVRIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2104 - protein, 208 aa, Artificial Sequence
  CD80 v291 ECD
VIHVTKEVKEVATLSCGHNVSVEELAQYRIYWHKDKKMVLTMMSGVINIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2105 - protein, 101 aa, Artificial Sequence
  CD80 v196 IgV
VIHVTKEVKEVATLSCGHNVSVEELEQTRIYWRKDKKMVLTMMSGDLNIWPEYKNRTIFDITNNLSIVILALRPSDEGTYECVVQEYEKDAFKREHLAEVT

SEQ ID NO: 2106 - protein, 101 aa, Artificial Sequence
  CD80 v197 IgV
VIHVTKEVKEVATLSCGHNVSVEELEQTRIYWRKDKKMVLTMMSGDLNIWPEYKNRTIFDITNNLSIVILALRPSDEGTYECVVQKYEKDAFKREHLAEVT

SEQ ID NO: 2107 - protein, 101 aa, Artificial Sequence
  CD80 v198 IgV
VIHVTKEVKEVATLSCGHNVSVEELAQTRIYWQKDKKMVLTMMSGDLNIWPEYKNRTIFDITNNLSIVILALRPSDEGTYECVVQKYEKDAFKREHLAEVT

SEQ ID NO: 2108 - protein, 101 aa, Artificial Sequence
  CD80 v199 IgV
VIHVTKEVKEVATLSCGHNVSVEELEQTRIYWLKDKKMVLTMMSGDLNIWPEYKNRTIFDITNNLSIVILALRPSDEGTYECVVQKYEKDAFKREHLAEVT

SEQ ID NO: 2109 - protein, 101 aa, Artificial Sequence
  CD80 v200 IgV
VIHVTKEVKEVATLSCGHNVSVEELEQTRIYWLKDKKMVLTMMSGDLNIWPEYKNRTIFDITNNLSIVILALRPSDEGTYECVVLKYEKDAFKREHLAEVT

SEQ ID NO: 2110 - protein, 101 aa, Artificial Sequence
  CD80 v201 IgV
VIHVTKEVKEVATLSCGYNVSVEELEQTRIYWLKDKKMVLTMMSGDLNIWPEYKNRTIFDITNNLSIVILALRPSDEGTYECVVQKYEKDAFKREHLAEVT

SEQ ID NO: 2111 - protein, 101 aa, Artificial Sequence
  CD80 v202 IgV
VIHVTKEVKEVATLSCGHNVSVEELAQTRIYWLKDKKMVLTMMSGDINIWPEYKNRTIFDITNNLSIVILALRPSDEGTYECVVLKYEKDAFKREHLAEVT

SEQ ID NO: 2112 - protein, 101 aa, Artificial Sequence
  CD80 v203 IgV
VIHVTKEVKEVATLSCGYNVSVEELAQTRIYWLKDKKMVLTMMSGDINIWPEYKNRTIFDITNNLSIVILALRPSDEGTYECVVLKYEKDAFKREHLAEVT

SEQ ID NO: 2113 - protein, 101 aa, Artificial Sequence
  CD80 v204 IgV
VIHVTKEVKEVATLSCGHNVSVEELAQTRIYWLKDKKMVLTMMSGEINIWPEYKNRTIFDITNNLSIVILALRPSDEGTYECVVLKYEKDAFKREHLAEVT

SEQ ID NO: 2114 - protein, 101 aa, Artificial Sequence
  CD80 v205 IgV
VIHVTKEVKEVATLSCGHNVSVEELAQTRIYWRKDKKMVLTMMSGEINIWPEYKNRTIFDITNNLSIVILALRPSDEGTYECVVLKYEKDAFKREHLAEVT

SEQ ID NO: 2115 - protein, 101 aa, Artificial Sequence
  CD80 v206 IgV
VIHVTKEVKEVATLSCGYNVSVEELAQTRIYWQKDKKMVLTMMSGDLNIWPEYKNRTIFDITNNLSIVILALRPSDEGTYECVVLKYEKDAFKREHLAEVT

SEQ ID NO: 2116 - protein, 101 aa, Artificial Sequence
  CD80 v207 IgV
VIHVTKEVKEVATLSCGHNVSVEELAQTRIYWLKDKKMVLTMMSGDVNIWPEYKNRTIFDITNNLSIVILALRPSDEGTYECVVLKYEKDAFKREHLAEVT

SEQ ID NO: 2117 - protein, 101 aa, Artificial Sequence
  CD80 v208 IgV
VIHVTKEVKEVATLSCGHNVSVEELAQTRIYWLKDKKMVLTMMSGDVNIWPEYKNRTIFDITNNLSIVILALRPSDEGAYECVVLKYEKDAFKREHLAEVT

SEQ ID NO: 2118 - protein, 101 aa, Artificial Sequence
  CD80 v209 IgV
VIHVTKEVKEVATLSCGHNVSVEELAQTRIYWLKDKKMVLSMMSGDVNIWPEYKNRTIFDITNNLSIVILALRPSDEGTYECVVLKYEKDAFKREHLAEVT

SEQ ID NO: 2119 - protein, 101 aa, Artificial Sequence
  CD80 v210 IgV
VIHVTKEVKEVATLSCGHNVSVEELAQTRIYWLKDKKMVLTMMSGDINIWPEYKNRTIFDITNNLSIVILALRPSDEGTYECVVQKYEKDAFKREHLAEVT

SEQ ID NO: 2120 - protein, 101 aa, Artificial Sequence
  CD80 v211 IgV
VIHVTKEVKEVATLSCGHNVSVEELAQTRIYWLKDKKMVLTMMSGDINIWPEYKNRTIFDINNNLSIVILALRPSDEGTYECVVQKYEKDAFKREHLAEVT

SEQ ID NO: 2121 - protein, 101 aa, Artificial Sequence
  CD80 v212 IgV
VIHVTKEVKEVATLSCGHNVSVEELAQTRIYWLKDKKMVLTMMSGDVNIWPEYKNRTIFDITNNLSIVILALRPSDEGTYECVVQKYEKDAFKREHLAEVT

SEQ ID NO: 2122 - protein, 101 aa, Artificial Sequence
  CD80 v213 IgV
VIHVTKEVKEVATLSCGHNVSVEELEQTRIYWQKDKKMVLTMTSGDLNIWPEYKNRTIFDITNNLSIVILALRPSDEGTYECVVQKYEKDAFKQEHLAEVT

SEQ ID NO: 2123 - protein, 101 aa, Artificial Sequence
  CD80 v214 IgV
VIHVTKEVKEVATLSCGHNVSVEELAQTRIYWRKDKEMVLTMMSGDVNIWPEYKNRTIFDITNNLSIVILALRPSDEGTYECVVQKYEKDAFKREHLAEVT

SEQ ID NO: 2124 - protein, 101 aa, Artificial Sequence
  CD80 v215 IgV
VIHVTKEVKEVATLSCGHNVSADELAQTRIYWLKDKKMVLTMMSGDVNIWPEYKNRTIFDITNNLSIVILALRPSDEGTYECVVLKYEKDAFKREHLAEVT

SEQ ID NO: 2125 - protein, 101 aa, Artificial Sequence
  CD80 v216 IgV
VIHVTKEVKEVATLSCGHNVSVEDLAQTRIYWLKDKKMVLTMMSGDVNIWPEYRNRTIFDITNNLSIVILALRPSDEGTYECVVQKYEKDAFKREHLAEVT

SEQ ID NO: 2126 - protein, 101 aa, Artificial Sequence
  CD80 v217 IgV
VIHVTKEVKEVATLPCGHNVSVEELAQTRIYWLKDKKMVLTMMSGDLNIWPEYKNRTIFDITNNLSIVILALRPSDEGTYECVVQKYEKDAFKREHLAEVT

SEQ ID NO: 2127 - protein, 101 aa, Artificial Sequence
  CD80 v218 IgV
VIHVTKDVKEVATLSCGHNVSVEELAQTRIYWQKDKKMVLTMMSGDINIWPEYKNRTIFDITNNLSIVILALRPSDEGTYECVVLKYEKDAFKREHQAEVT

SEQ ID NO: 2128 - protein, 101 aa, Artificial Sequence
  CD80 v219 IgV
VIHVTKEVKEVATLSCGHNVSVEELAQTRIYWLKDKKMVLSMISGDMNIWPEYKNRTIFDITNNLSIVILALRPSDEGTYECVVLKYEKDAFKREHLAEVT

SEQ ID NO: 2129 - protein, 101 aa, Artificial Sequence
  CD80 v220 IgV
VIHVTKEVKEVATLSCGHNVSVEELAQTRIYWQKDKKMVLTMMSGDINIWPEYRNRTIFDITNNLSIVILALRPSDEGTYECVVEKYEKDAFKREHLAEVT

SEQ ID NO: 2130 - protein, 101 aa, Artificial Sequence
  CD80 v221 IgV
VIHVTKEVKEVATLSCGHNVSVEELAQTRIYWKKDKKMVLTMMSGVMNIWPEYKNRTIFDITNNLSIVILALRPSDEGTYECVVQKYEKDAFKREHLAEVT

SEQ ID NO: 2131 - protein, 101 aa, Artificial Sequence
  CD80 v222 IgV
VIHVTKEVKEVATLSCGHNVSVEELAQTRISWQKDKKMVLTMMSGDLNIWPEYKNRTIFDITNNLSIVILALRPSDEGLYECVVLKYGKDAFKREHLAEVT

SEQ ID NO: 2132 - protein, 101 aa, Artificial Sequence
  CD80 v223 IgV
VIHVTKEVKEVATLSCGLNVSAEELAQTRIYWQKDKKMVLTMMSGDLTIWPEYKNRTIFDITNNLSIVILALRPSDEGTYECVVQKYEKDAFKREHLAEVT

SEQ ID NO: 2133 - protein, 101 aa, Artificial Sequence
  CD80 v224 IgV
VIHVTKEVKEVATLSCGHNVSVEELAHTRIYWQKDKKMVLTMMSGDLNIWPEYKNRTIFDITNNLSIVILALRPSDEGTYECVVQKYEKDAFKQKHLAEVT

SEQ ID NO: 2134 - protein, 101 aa, Artificial Sequence
  CD80 v225 IgV
VIHVTKEVKEVATLSCGHNVSVEELAQTRIYWKKDKKMVLTMMSGDVNIWPEYKNRTIFDITNNLSIVILALRPSDEGTYECVVLKYEEDAFRREHLAEVT

SEQ ID NO: 2135 - protein, 101 aa, Artificial Sequence
  CD80 v226 IgV
VIHVTKEVKEVATLSCGHNVSVEELAQTRIYWQKDKKMVLTMMSGDINIWPEYKNRTIFDITNNLSIVILALRPSDAGTYECVVQKYEKDAFKWEHLAEVT

SEQ ID NO: 2136 - protein, 101 aa, Artificial Sequence
  CD80 v227 IgV
VIHVTKEVKEVATLSCGHNVSVEELEQTRIYWQKDKKMVLTMISGDLNIWPEYKNRTIFDITNNLSIVILALRPSDEGTYECVVQEYEKDAFKWEHLAEVT

SEQ ID NO: 2137 - protein, 101 aa, Artificial Sequence
  CD80 v228 IgV
VIHVTKEVKEVATLSCGHNVSVEELAHTRIYWLKDKKMVLTMMSGDVNIWPEYKDRTIFDITNNLSIVILALRPSDEGTYECVVQKYENDAFKREHLAEVT

SEQ ID NO: 2138 - protein, 101 aa, Artificial Sequence
  CD80 v229 IgV
VIHVTKEVKEVATLSCGYNASVEELAQTRIYWLKDKKMVLTMMSGDVNIWPEFKNRTIFDITNNLSIVILALRPSDEGTYECVVLKYEKDAFKREHLAEVT

SEQ ID NO: 2139 - protein, 101 aa, Artificial Sequence
  CD80 v230 IgV
VIHVTKEVKEVATLSCGHNVSAEELAQTRIYWQKDKKMVLTMMSGDMNIWPEYKNRTIFDITNNLSIEILDLRPSDEGTYECVVLKYEKDAFKREHLAEVT

SEQ ID NO: 2140 - protein, 101 aa, Artificial Sequence
  CD80 v231 IgV
VIHVTKEVKEVATLSCGHNVSVEELAQTRIYWLKDKKMVLTMMSGDLNIWPEYKNRTIFDITNNLSIVILGLRPSDEGTYECVVLKYEKDASKREHLAEVT

SEQ ID NO: 2141 - protein, 101 aa, Artificial Sequence
  CD80 v232 IgV
VIHVTKEVKEVATLSCGHNVSAEELAQTHIYWQKDKKMVLTMMSGEINIWPEYKNRTIFDITNNLSIVILALRPSDEGTYECVVLKYEKDAFKREHLAEVT

SEQ ID NO: 2142 - protein, 101 aa, Artificial Sequence
  CD80 v233 IgV
VIHVTKEVKEVATLSCGHNVSVEELAQTRIYWLKDKKMVLTMISGDMNIWPEYKNRTIFDITNNLSIVILALRPSDEGTYECVVQKYEKDAFKWEHLAEVT

SEQ ID NO: 2143 - protein, 101 aa, Artificial Sequence
  CD80 v234 IgV
VIHVTKEVKEVATLSCGYNVSVEELAQTRIYWQKDKKMVLTMMSGDMNIWPEYKNRTIFDITNNLSIMILALRPSDEGTYECVVLKYEKDAFKREHQAEVT

SEQ ID NO: 2144 - protein, 101 aa, Artificial Sequence
  CD80 v235 IgV
VIHVTKEVKEVATLSCGHNVSVEELAQTRIYWLKDKKMVLTMMSGDLNIWPEYKNRTIFDITNNLSIMILALRPSDEGTYECVVQKYDKDAFKREHLAEVT

SEQ ID NO: 2145 - protein, 101 aa, Artificial Sequence
  CD80 v236 IgV
VIHVTKEVKEVATLSCGHNVSVEELAQTRIYWLKDKKMVLTMVSGDINIWPEYKNRTIFDITNNLSIVILGLRPSDEGTYECVVLKYEKDAFKREHLAEVT

SEQ ID NO: 2146 - protein, 101 aa, Artificial Sequence
  CD80 v237 IgV
VIHVTKEVKEVATLSCGHNVSVEELAQTRIYWQKDKKMVLTMMSGDLNIWPEYKNRTIFDITNNLSIVILGLRPSDEGTYECVVLKYEKDAFKREHQAEVT

SEQ ID NO: 2147 - protein, 101 aa, Artificial Sequence
  CD80 v238 IgV
VIHVTKEVKEVATLSCGHNVSVEELAQTRIYWQKDKKMVLTMMSGDVNIWPEYKNRTIFDITNNLSIVILGLRPSDEGTYECVVMKYEKDAFKREHQAEVT

SEQ ID NO: 2148 - protein, 101 aa, Artificial Sequence
  CD80 v239 IgV
VIHVTKEVKEVATLSCGYNVSVEELAQTRIHWQKDKKMVLTMMSGDVNIWPEYKNRTIFDITNNLSIVILGLRPSDEGTYECVVQKYEKDAFKREHLAEVT

SEQ ID NO: 2149 - protein, 101 aa, Artificial Sequence
  CD80 v240 IgV
VIHVTKEVKEVATLSCGHNVSVEELAQTRIYWQKDKKMVLTMMSGEVNIWPEYKNRTIFDITNNLSIVILALRPSDEGTYECVVLKYEKDAFKREHQAEVT

SEQ ID NO: 2150 - protein, 101 aa, Artificial Sequence
  CD80 v241 IgV
VIHVTKEVKEVATLSCGHNVSVEELAQTRIYWQKDKKMVLTMMSGVINIWPEYKNRTIFDITNNLSIVILGLRPSDEGTYECVVLKYEKDAVKREHLAEVT

SEQ ID NO: 2151 - protein, 101 aa, Artificial Sequence
  CD80 v242 IgV
VIHVTKEVKEVATLSCGHNVSVEELAQTRIYWQKDKKMVLTMMSGDVNIWPEYKNRTIFDIANNLSIVILGLRPSDEGTYECAVLKHEKDAFKREHMAEVT

SEQ ID NO: 2152 - protein, 101 aa, Artificial Sequence
  CD80 v243 IgV
VIHVTKEVKEVATLSCGHNVSVEELAQTRIYWLKDKKMVLTMMSGDMKIWPEYKNRTIFDITNNLSIVILALRPSDEGTYECVVQKYEKDAFKREHQAEVT

SEQ ID NO: 2153 - protein, 101 aa, Artificial Sequence
  CD80 v244 IgV
VIHVTKEVKEVATLSCGHNVSVEELAQTRIYWQKDKKMVLTMMSGDMNIWPEYKNRTIFDITNNLSIVILALRPSDEGTYECVVQKYEKDAFTRVHQAEVT

SEQ ID NO: 2154 - protein, 101 aa, Artificial Sequence
  CD80 v245 IgV
VIHVTKEVKEVATLSCGHNVSVEELAQTRIYWQKDKKMVLTMMSGDVKIWPEYKNRTIFDITNNLSIMILALRPSDEGTYECVVLKYENDAFKREHLAEVT

SEQ ID NO: 2155 - protein, 101 aa, Artificial Sequence
  CD80 v246 IgV
VIHVTKEVKEVATLSCGHNVSVEELAQTRIYWLKDKKMVLTMMSGDIDIWPEYKNRTIFDITNNLSIVILGLRPSDEGTYECVVLKYEKDAFKREHLAEVT

SEQ ID NO: 2156 - protein, 101 aa, Artificial Sequence
  CD80 v247 IgV
VIHVTKEVKEVATLSCGHNVSVEELAQTHIYWQKDKKMVLTMVSGDINVWPEYKNRTIFDITNNLSIVILALRPSDEGTYECVVLKYEKDAFKREHLAEVT

SEQ ID NO: 2157 - protein, 101 aa, Artificial Sequence
  CD80 v248 IgV
VIHVTKEVKEVATLSCGHNVSVEELAHTRIYWQKDKKMVLTMMSGDINIWPEYKNRTIFDITNNLSIVILALRPSDEGTYECVVQKYEKGAFKREHLAEVT

SEQ ID NO: 2158 - protein, 101 aa, Artificial Sequence
  CD80 v249 IgV
VIHVTKEVKEVATLSCGHNVSVEELAQTRIYWQKDKKMVLTMMSGDINIWPEYKNRTIFDITNNLSIVILALRPSDEGTYECVVQKYEKGAFKREHLAEVT

SEQ ID NO: 2159 - protein, 101 aa, Artificial Sequence
  CD80 v250 IgV
VIHVTKEVKEVATLSCGHNVSVEELAQTRIYWQKDKKMVLTMMSGDINIWPEYKNRTIFDISNNLSIVILALRPSDEGTYECVVQKYEKDAFKREHLAEVT

SEQ ID NO: 2160 - protein, 101 aa, Artificial Sequence
  CD80 v251 IgV
VIHVTKEVKEVATLSCGHNVSVEELEQTRIYWQKDKKMVLTMMSGDLNIWPEYKNRTIFDITNNLSIVILGLRPSDEGTYECVVLKYEKDAFKREHLAEVT

SEQ ID NO: 2161 - protein, 101 aa, Artificial Sequence
  CD80 v252 IgV
VIHVTKEVKEVATLSCGHNVSVEELAQTRIYWQKDKKMVLTMMSGDINIWPEYKNRTIFDITNNLSIVILALRPSDEGTYECVVLKQEEDAFKREHLAEVT

SEQ ID NO: 2162 - protein, 101 aa, Artificial Sequence
  CD80 v253 IgV
VIHVTKEVKEVATLSCGHNVSAEELAQTRIYWQKDKKMVLTMMSGDINIWPEYKNRTIFDITNNLSIVILALRPSDEGTYECVVLKNEKDAFKREHLAEVT

SEQ ID NO: 2163 - protein, 101 aa, Artificial Sequence
  CD80 v254 IgV
VIHVTKEVKEVATLSCGYNVSVEELEQTRIYWQKDKKMVLTMMSGDLNIWPEYKNRTIFDITNNLSIVILALRPSDEGTYECVVQKYEKGAFKREHLAEVT

SEQ ID NO: 2164 - protein, 101 aa, Artificial Sequence
  CD80 v255 IgV
VIHVTKEVKEVATLSCGHNVSVEELAQTRIYWQKDKKMVLTMMSGDLNIWPEYKNRTIFDITNNLSIVILGLRPSDEGTYECVVQKYEKDAFKREHLAEVT

SEQ ID NO: 2165 - protein, 101 aa, Artificial Sequence
  CD80 v256 IgV
VIHVTKEVKEVATLSCGHNVSVEELAQTRIYWQKDKKMVLTMMSGDVNIWPEYKNRTIFDITNNLSIVILGLRPSDEGTYECVVLKYDKDAFKREHLAEVT

SEQ ID NO: 2166 - protein, 101 aa, Artificial Sequence
  CD80 v257 IgV
VIHVTKEVKEVATLSCGHNVSVEELAQTRIYWQKDKKMVLTMMSGDMNIWPEYKNRTIFDITNNLSIVILGLRPSDEGTYECVVLKYEKDAFKREHLAEVT

SEQ ID NO: 2167 - protein, 101 aa, Artificial Sequence
  CD80 v258 IgV
VIHVTKEVKEVATLSCGHNVSVEELAQTRIYWQKDKKMVLTMMSGDVNIWPEYKNRTIFDITNNLSIVILGLRPSDEGTYECVVLKYEKDAFKREHLAEVT

SEQ ID NO: 2168 - protein, 101 aa, Artificial Sequence
  CD80 v259 IgV
VIHVTKEVKEVATLSCGHNVSVEELAQTRVYWQKDKKMVLTMMSGDVNIWPEYKNRTIFDITNNLSIVILGLRPSDEGTYECVVLKYEKDVFKREHLAEVT

SEQ ID NO: 2169 - protein, 101 aa, Artificial Sequence
  CD80 v260 IgV
VIHVTKEVKEVATLSCGHNVSVEELAQTRVCWQKDKKMVLTMMSGDVNIWPEYKNRTIFDITNNLSIVILGLRPSDEGTYECVVMKYEKDAFKREHLAEVT

SEQ ID NO: 2170 - protein, 101 aa, Artificial Sequence
  CD80 v261 IgV
VIHVTKEVKEVATLSCGHNVSDEELAQTRIYWQKDKKMVLTMMSGDLNIWPEYKNRTIFDITNNLSIVILALRPSDEGTYECVVQKYEKDAFKREHLAEVT

SEQ ID NO: 2171 - protein, 101 aa, Artificial Sequence
  CD80 v262 IgV
VIHVTKEVKEVATLSCGYNVSVEELAQTRIYWQKDKKMVLTMMSGDMKIWPEYKNRTIFDITNNLSIVILALRPSDEGTYECVVLKYEKDAFKREHLAEVT

SEQ ID NO: 2172 - protein, 101 aa, Artificial Sequence
  CD80 v263 IgV
VIHVTKEVKEVATLSCGHNVSVEELAQTRIYWQKDKKMVLSMMSGDVNIWPEYKNRTIFDITNNLSIVILGLRPSDEGTYECVVLKYENDAFKREHLAEVT

SEQ ID NO: 2173 - protein, 101 aa, Artificial Sequence
  CD80 v264 IgV
VIHVTKEVKEVATLSCGHNVSVEELAQTRIYWQKDKKMVLTMMSGDVTIWPEYKNRTIFDITNNLSIVILALRPSDEGTYECVVQKYEKDAFKREHLAEVT

SEQ ID NO: 2174 - protein, 101 aa, Artificial Sequence
  CD80 v265 IgV
VIHVTKEVKEVATLSCGHNVSVEELAQTRIYWQKDKKMVLTMMSGEVNIWPEYKNRTIFDITNNLSIVILDLRPSDEGTYECVVLKYEKGAFKREHLAEVT

SEQ ID NO: 2175 - protein, 101 aa, Artificial Sequence
  CD80 v266 IgV
VIHVTKEVKEVATLSCGHNVSVEELAQTRIYWQKDKKMVLTMMSGEVNIWPEYKNRTIFDITNNLSIVILDLRPSDEGTYECVVLKYEKDAFKREHLAEVT

SEQ ID NO: 2176 - protein, 101 aa, Artificial Sequence
  CD80 v267 IgV
VIHVTKEVKEVATLSCGHNVSVEELAQTRIYWQKDKKMVLSMISGDMNIWPEYKNRTIFDITNNLSIVILGLRPSDEGTYECVVLKYEKGAFKREHLAEVT

SEQ ID NO: 2177 - protein, 101 aa, Artificial Sequence
  CD80 v268 IgV
VIHVTKEVKEVATLSCGHNVSVEELAQTRIYWQKDKKMVLSMISGDVNIWPEYKNRTIFDITNNLSIVILGLRPSDEGTYECVVLKYEKDAFKREHLAEVT

SEQ ID NO: 2178 - protein, 101 aa, Artificial Sequence
  CD80 v269 IgV
VIHVTKEVKEVATLSCGHNVSVEELAQTRIYWQKDKKMVLSMISGDLNIWPEYKNRTIFDITNNLSIVILGLRPSDEGTYECVVLKYEKDAFKREHLAEVT

SEQ ID NO: 2179 - protein, 101 aa, Artificial Sequence
  CD80 v270 IgV
VIHVTKEVKEVATLSCGYNVSAEELAQTRIYWQKDKKMVLTMMSGDVNIWPEYKNRTIFDISNNLSIVILGLRPSDEGTYECVVLKYEKDAFKREHLAEVT

SEQ ID NO: 2180 - protein, 101 aa, Artificial Sequence
  CD80 v271 IgV
VIHVTKEVKEVATLSCGYNVSVEELEQTRIYWQKDKKMVLTMMSGDLNIWPEYKNRTIFDITNNLSIMILGLRPSDEGTYECVVLKYEKGAFKREHLAEVT

SEQ ID NO: 2181 - protein, 101 aa, Artificial Sequence
  CD80 v272 IgV
VIHVTKEVKEVATLSCGHNVSVEELAQTRIYWQKDKEMVLTMMSGDVDIWPEYKNRTIFDITNNLSIVILALRPSDEGTYECVVQKYEKNAFKREHLAEVT

SEQ ID NO: 2182 - protein, 101 aa, Artificial Sequence
  CD80 v273 IgV
VIHVTKEVKEVATLSCGHNVSVEELAHTRIYWQKDKKMVLTMMSGVLNIWPEYKNRTIFDITNNLSIVILGLRPSDEGTYECVVLKYEKDAFKREHLAEVT

SEQ ID NO: 2183 - protein, 101 aa, Artificial Sequence
  CD80 v274 IgV
VIHVTKEVKEVATLSCGHNVSLEELAHTRIYWQKDKKMVLTMMSGDINIWPEYKNRTIFDITNNLSIVILGLRPSDEGTYECVVLKYEKDAFKREHLAEVT

SEQ ID NO: 2184 - protein, 101 aa, Artificial Sequence
  CD80 v275 IgV
VIHVTKEVKEVATLSCGHNVSVEELAQTRIYWQKDKKMVLTMMSGVLNIWPEYKNRTIFDITNNLSIMILALRPSDEGTYECVVQKYDKDAFKREHLAEVT

SEQ ID NO: 2185 - protein, 101 aa, Artificial Sequence
  CD80 v276 IgV
VIHVTKEVKEVATLSCGHNVSVEELAQTRIYWQKDKKMVLSMVSGDINIWPEYKNRTIFDITNNLSIVIMGLRPSDEGTYECVVLKYEKDAFKREHLAEVT

SEQ ID NO: 2186 - protein, 101 aa, Artificial Sequence
  CD80 v277 IgV
VIHVTKEVKEVATLSCGHNVSVEELAQTRIYWQKDKKMVLTMMSGEVNIWPEYKNRTIFDITDNLSIVILALRPSDEGTYECVVQKYEKDAFKREHLAEVT

SEQ ID NO: 2187 - protein, 101 aa, Artificial Sequence
  CD80 v278 IgV
VIHVTKEVKEVATLSCGHNVSVEELAQTRIYWQKDKKMVLTMMSGDVNIWPEYKNRTIFDIANNLSIVILDLRPSDEGTYECVVLKYEKDAFEREHLAEVT

SEQ ID NO: 2188 - protein, 101 aa, Artificial Sequence
  CD80 v279 IgV
VIHVTKEVKEVATLSCGHNVSVEELAQTRIYWQKDKKMVLTMMSGEVNIWPEYKNRTIFDITNNLSIMILALRPSDEGTYECVVLKYEKGAFEREHLAEVT

SEQ ID NO: 2189 - protein, 101 aa, Artificial Sequence
  CD80 v280 IgV
VIHVTKEVKEVATLSCGHNVSVEELAQTRIYWQKDKKMVLTMISGDVNIWPEYKNRTIFDITNNLSIVILALRPSDEGTYECVVLKYENDAFKREHLAEVT

SEQ ID NO: 2190 - protein, 101 aa, Artificial Sequence
  CD80 v281 IgV
VIHVTKEVKEVATLSCGHNVSVEELAQTRIYWQKDKKMVLTMMSGDLNIWPEYKNRTIFDITNNLSIVILGLRPSDEGTYECVVMKYEKDAYKREHLAEVT

SEQ ID NO: 2191 - protein, 101 aa, Artificial Sequence
  CD80 v282 IgV
VIHVTKEVKEVATLSCGHNVSVEELAQTRIYWQKDKKMVLTVMSGDVNIWPDYKNRTIFDITNNLSIVILALRPSDEGTYECVVQKYEKDAFKREHLAEVT

SEQ ID NO: 2192 - protein, 101 aa, Artificial Sequence
  CD80 v283 IgV
VIHVTKEVKEVATLSCGHNVSDEELAQTRIYWQKDKKMVLTMMSGDLNIWPEYKNRTIFDITNNLSIVIMALRPSDEGTYECVVLKYEKDAFKREHQAEVT

SEQ ID NO: 2193 - protein, 101 aa, Artificial Sequence
  CD80 v284 IgV
VIHVTKEVKEVATLSCGHNVSVEELAQTRIYWQKDKKMVLSMMSGDVNIWPEYKNRTIFDITNNLSIVILALRPSDEGTYECVVLKYEKDAFKREHQAEVT

SEQ ID NO: 2194 - protein, 101 aa, Artificial Sequence
  CD80 v285 IgV
VIHVTKEVKEVATLSCGHNVSVEELAQTRIYWQKDKKMVLTMMSGDMNIWPEHKNRTIFDITNNLSIVILGLRPSDEGTYECVVLKYEKGAFKREHRAEVT

SEQ ID NO: 2195 - protein, 101 aa, Artificial Sequence
  CD80 v286 IgV
VIHVTKEVKEVATLSCGHNVSVEELAQTRIYWQKDKKMVLTMMSGDMNIWPEYKNRTIFDITNNLSIVILDVHPSDEGTYKCVVLKYEKDAFKREHLAEVT

SEQ ID NO: 2196 - protein, 101 aa, Artificial Sequence
  CD80 v287 IgV
VIHVTKEVKEVATLSCGHNVSVEELAQTRIYWLKDKKMVLTMISGDMNIWPEFKNRTIFDISNNLSIVILALRPSDEGTYECVVQKYEKDAFKREHLAEVT

SEQ ID NO: 2197 - protein, 101 aa, Artificial Sequence
  CD80 v288 IgV
VIHVTKEVKEVATLSCGHNVSVEELAQTRIYWQKDKKTVLTMMSGEVSIWPEYKNRTIFDITNNLSIVILALRPSDEGTYECVVLKYEKDAFKREHLAEVT

SEQ ID NO: 2198 - protein, 101 aa, Artificial Sequence
  CD80 v289 IgV
VIHVTKEVKEVATLSCGHNVSVEELAQTRIYWRKDKKMVLTMMSGDVKIWPEYKNRTIFDITNNLSIVILALRPSDEGTYECVVMKYEKDALKREHLAEVT

SEQ ID NO: 2199 - protein, 101 aa, Artificial Sequence
  CD80 v290 IgV
VIHVTKEVKEVATLSCGHNVSVEELAQTRIYWQKDKKTVLTMVSGDVRIWPEYKNRTIFDITNNLSIVILALRPSDEGTYECVVQKYEKDAFKREHLAEVT

SEQ ID NO: 2200 - protein, 101 aa, Artificial Sequence
  CD80 v291 IgV
VIHVTKEVKEVATLSCGHNVSVEELAQYRIYWHKDKKMVLTMMSGVINIWPEYKNRTIFDITNNLSIVILGLRPSDEGTYECVVLKYEKDAFKREHLAEVT

SEQ ID NO: 2201 - protein, 107 aa, Artificial Sequence
  CD80 v196 IgV
VIHVTKEVKEVATLSCGHNVSVEELEQTRIYWRKDKKMVLTMMSGDLNIWPEYKNRTIFDITNNLSIVILALRPSDEGTYECVVQEYEKDAFKREHLAEVTLSVKAD

SEQ ID NO: 2202 - protein, 107 aa, Artificial Sequence
  CD80 v197 IgV
VIHVTKEVKEVATLSCGHNVSVEELEQTRIYWRKDKKMVLTMMSGDLNIWPEYKNRTIFDITNNLSIVILALRPSDEGTYECVVQKYEKDAFKREHLAEVTLSVKAD

SEQ ID NO: 2203 - protein, 107 aa, Artificial Sequence
  CD80 v198 IgV
VIHVTKEVKEVATLSCGHNVSVEELAQTRIYWQKDKKMVLTMMSGDLNIWPEYKNRTIFDITNNLSIVILALRPSDEGTYECVVQKYEKDAFKREHLAEVTLSVKAD

SEQ ID NO: 2204 - protein, 107 aa, Artificial Sequence
  CD80 v199 IgV
VIHVTKEVKEVATLSCGHNVSVEELEQTRIYWLKDKKMVLTMMSGDLNIWPEYKNRTIFDITNNLSIVILALRPSDEGTYECVVQKYEKDAFKREHLAEVTLSVKAD

SEQ ID NO: 2205 - protein, 107 aa, Artificial Sequence
  CD80 v200 IgV
VIHVTKEVKEVATLSCGHNVSVEELEQTRIYWLKDKKMVLTMMSGDLNIWPEYKNRTIFDITNNLSIVILALRPSDEGTYECVVLKYEKDAFKREHLAEVTLSVKAD

SEQ ID NO: 2206 - protein, 107 aa, Artificial Sequence
  CD80 v201 IgV
VIHVTKEVKEVATLSCGYNVSVEELEQTRIYWLKDKKMVLTMMSGDLNIWPEYKNRTIFDITNNLSIVILALRPSDEGTYECVVQKYEKDAFKREHLAEVTLSVKAD

SEQ ID NO: 2207 - protein, 107 aa, Artificial Sequence
  CD80 v202 IgV
VIHVTKEVKEVATLSCGHNVSVEELAQTRIYWLKDKKMVLTMMSGDINIWPEYKNRTIFDITNNLSIVILALRPSDEGTYECVVLKYEKDAFKREHLAEVTLSVKAD

SEQ ID NO: 2208 - protein, 107 aa, Artificial Sequence
  CD80 v203 IgV
VIHVTKEVKEVATLSCGYNVSVEELAQTRIYWLKDKKMVLTMMSGDINIWPEYKNRTIFDITNNLSIVILALRPSDEGTYECVVLKYEKDAFKREHLAEVTLSVKAD

SEQ ID NO: 2209 - protein, 107 aa, Artificial Sequence
  CD80 v204 IgV
VIHVTKEVKEVATLSCGHNVSVEELAQTRIYWLKDKKMVLTMMSGEINIWPEYKNRTIFDITNNLSIVILALRPSDEGTYECVVLKYEKDAFKREHLAEVTLSVKAD

SEQ ID NO: 2210 - protein, 107 aa, Artificial Sequence
  CD80 v205 IgV
VIHVTKEVKEVATLSCGHNVSVEELAQTRIYWRKDKKMVLTMMSGEINIWPEYKNRTIFDITNNLSIVILALRPSDEGTYECVVLKYEKDAFKREHLAEVTLSVKAD

SEQ ID NO: 2211 - protein, 107 aa, Artificial Sequence
  CD80 v206 IgV
VIHVTKEVKEVATLSCGYNVSVEELAQTRIYWQKDKKMVLTMMSGDLNIWPEYKNRTIFDITNNLSIVILALRPSDEGTYECVVLKYEKDAFKREHLAEVTLSVKAD

SEQ ID NO: 2212 - protein, 107 aa, Artificial Sequence
  CD80 v207 IgV
VIHVTKEVKEVATLSCGHNVSVEELAQTRIYWLKDKKMVLTMMSGDVNIWPEYKNRTIFDITNNLSIVILALRPSDEGTYECVVLKYEKDAFKREHLAEVTLSVKAD

SEQ ID NO: 2213 - protein, 107 aa, Artificial Sequence
  CD80 v208 IgV
VIHVTKEVKEVATLSCGHNVSVEELAQTRIYWLKDKKMVLTMMSGDVNIWPEYKNRTIFDITNNLSIVILALRPSDEGAYECVVLKYEKDAFKREHLAEVTLSVKAD

SEQ ID NO: 2214 - protein, 107 aa, Artificial Sequence
  CD80 v209 IgV
VIHVTKEVKEVATLSCGHNVSVEELAQTRIYWLKDKKMVLSMMSGDVNIWPEYKNRTIFDITNNLSIVILALRPSDEGTYECVVLKYEKDAFKREHLAEVTLSVKAD

SEQ ID NO: 2215 - protein, 107 aa, Artificial Sequence
  CD80 v210 IgV
VIHVTKEVKEVATLSCGHNVSVEELAQTRIYWLKDKKMVLTMMSGDINIWPEYKNRTIFDITNNLSIVILALRPSDEGTYECVVQKYEKDAFKREHLAEVTLSVKAD

SEQ ID NO: 2216 - protein, 107 aa, Artificial Sequence
  CD80 v211 IgV
VIHVTKEVKEVATLSCGHNVSVEELAQTRIYWLKDKKMVLTMMSGDINIWPEYKNRTIFDINNNLSIVILALRPSDEGTYECVVQKYEKDAFKREHLAEVTLSVKAD

SEQ ID NO: 2217 - protein, 107 aa, Artificial Sequence
  CD80 v212 IgV
VIHVTKEVKEVATLSCGHNVSVEELAQTRIYWLKDKKMVLTMMSGDVNIWPEYKNRTIFDITNNLSIVILALRPSDEGTYECVVQKYEKDAFKREHLAEVTLSVKAD

SEQ ID NO: 2218 - protein, 107 aa, Artificial Sequence
  CD80 v213 IgV
VIHVTKEVKEVATLSCGHNVSVEELEQTRIYWQKDKKMVLTMTSGDLNIWPEYKNRTIFDITNNLSIVILALRPSDEGTYECVVQKYEKDAFKQEHLAEVTLSVKAD

SEQ ID NO: 2219 - protein, 107 aa, Artificial Sequence
  CD80 v214 IgV
VIHVTKEVKEVATLSCGHNVSVEELAQTRIYWRKDKEMVLTMMSGDVNIWPEYKNRTIFDITNNLSIVILALRPSDEGTYECVVQKYEKDAFKREHLAEVTLSVKAD

SEQ ID NO: 2220 - protein, 107 aa, Artificial Sequence
  CD80 v215 IgV
VIHVTKEVKEVATLSCGHNVSADELAQTRIYWLKDKKMVLTMMSGDVNIWPEYKNRTIFDITNNLSIVILALRPSDEGTYECVVLKYEKDAFKREHLAEVTLSVKAD

SEQ ID NO: 2221 - protein, 107 aa, Artificial Sequence
  CD80 v216 IgV
VIHVTKEVKEVATLSCGHNVSVEDLAQTRIYWLKDKKMVLTMMSGDVNIWPEYRNRTIFDITNNLSIVILALRPSDEGTYECVVQKYEKDAFKREHLAEVTLSVKAD

SEQ ID NO: 2222 - protein, 107 aa, Artificial Sequence
  CD80 v217 IgV
VIHVTKEVKEVATLPCGHNVSVEELAQTRIYWLKDKKMVLTMMSGDLNIWPEYKNRTIFDITNNLSIVILALRPSDEGTYECVVQKYEKDAFKREHLAEVTLSVKAD

SEQ ID NO: 2223 - protein, 107 aa, Artificial Sequence
  CD80 v218 IgV
VIHVTKDVKEVATLSCGHNVSVEELAQTRIYWQKDKKMVLTMMSGDINIWPEYKNRTIFDITNNLSIVILALRPSDEGTYECVVLKYEKDAFKREHQAEVTLSVKAD

SEQ ID NO: 2224 - protein, 107 aa, Artificial Sequence
  CD80 v219 IgV
VIHVTKEVKEVATLSCGHNVSVEELAQTRIYWLKDKKMVLSMISGDMNIWPEYKNRTIFDITNNLSIVILALRPSDEGTYECVVLKYEKDAFKREHLAEVTLSVKAD

SEQ ID NO: 2225 - protein, 107 aa, Artificial Sequence
  CD80 v220 IgV
VIHVTKEVKEVATLSCGHNVSVEELAQTRIYWQKDKKMVLTMMSGDINIWPEYRNRTIFDITNNLSIVILALRPSDEGTYECVVEKYEKDAFKREHLAEVTLSVKAD

SEQ ID NO: 2226 - protein, 107 aa, Artificial Sequence
  CD80 v221 IgV
VIHVTKEVKEVATLSCGHNVSVEELAQTRIYWKKDKKMVLTMMSGVMNIWPEYKNRTIFDITNNLSIVILALRPSDEGTYECVVQKYEKDAFKREHLAEVTLSVKAD

SEQ ID NO: 2227 - protein, 107 aa, Artificial Sequence
  CD80 v222 IgV
VIHVTKEVKEVATLSCGHNVSVEELAQTRISWQKDKKMVLTMMSGDLNIWPEYKNRTIFDITNNLSIVILALRPSDEGLYECVVLKYGKDAFKREHLAEVTLSVKAD

SEQ ID NO: 2228 - protein, 107 aa, Artificial Sequence
  CD80 v223 IgV
VIHVTKEVKEVATLSCGLNVSAEELAQTRIYWQKDKKMVLTMMSGDLTIWPEYKNRTIFDITNNLSIVILALRPSDEGTYECVVQKYEKDAFKREHLAEVTLSVKAD

SEQ ID NO: 2229 - protein, 107 aa, Artificial Sequence
  CD80 v224 IgV
VIHVTKEVKEVATLSCGHNVSVEELAHTRIYWQKDKKMVLTMMSGDLNIWPEYKNRTIFDITNNLSIVILALRPSDEGTYECVVQKYEKDAFKQKHLAEVTLSVKAD

SEQ ID NO: 2230 - protein, 107 aa, Artificial Sequence
  CD80 v225 IgV
VIHVTKEVKEVATLSCGHNVSVEELAQTRIYWKKDKKMVLTMMSGDVNIWPEYKNRTIFDITNNLSIVILALRPSDEGTYECVVLKYEEDAFRREHLAEVTLSVKAD

SEQ ID NO: 2231 - protein, 107 aa, Artificial Sequence
  CD80 v226 IgV
VIHVTKEVKEVATLSCGHNVSVEELAQTRIYWQKDKKMVLTMMSGDINIWPEYKNRTIFDITNNLSIVILALRPSDAGTYECVVQKYEKDAFKWEHLAEVTLSVKAD

SEQ ID NO: 2232 - protein, 107 aa, Artificial Sequence
  CD80 v227 IgV
VIHVTKEVKEVATLSCGHNVSVEELEQTRIYWQKDKKMVLTMISGDLNIWPEYKNRTIFDITNNLSIVILALRPSDEGTYECVVQEYEKDAFKWEHLAEVTLSVKAD

SEQ ID NO: 2233 - protein, 107 aa, Artificial Sequence
  CD80 v228 IgV
VIHVTKEVKEVATLSCGHNVSVEELAHTRIYWLKDKKMVLTMMSGDVNIWPEYKDRTIFDITNNLSIVILALRPSDEGTYECVVQKYENDAFKREHLAEVTLSVKAD

SEQ ID NO: 2234 - protein, 107 aa, Artificial Sequence
  CD80 v229 IgV
VIHVTKEVKEVATLSCGYNASVEELAQTRIYWLKDKKMVLTMMSGDVNIWPEFKNRTIFDITNNLSIVILALRPSDEGTYECVVLKYEKDAFKREHLAEVTLSVKAD

SEQ ID NO: 2235 - protein, 107 aa, Artificial Sequence
  CD80 v230 IgV
VIHVTKEVKEVATLSCGHNVSAEELAQTRIYWQKDKKMVLTMMSGDMNIWPEYKNRTIFDITNNLSIEILDLRPSDEGTYECVVLKYEKDAFKREHLAEVTLSVKAD

SEQ ID NO: 2236 - protein, 107 aa, Artificial Sequence
  CD80 v231 IgV
VIHVTKEVKEVATLSCGHNVSVEELAQTRIYWLKDKKMVLTMMSGDLNIWPEYKNRTIFDITNNLSIVILGLRPSDEGTYECVVLKYEKDASKREHLAEVTLSVKAD

SEQ ID NO: 2237 - protein, 107 aa, Artificial Sequence
  CD80 v232 IgV
VIHVTKEVKEVATLSCGHNVSAEELAQTHIYWQKDKKMVLTMMSGEINIWPEYKNRTIFDITNNLSIVILALRPSDEGTYECVVLKYEKDAFKREHLAEVTLSVKAD

SEQ ID NO: 2238 - protein, 107 aa, Artificial Sequence
  CD80 v233 IgV
VIHVTKEVKEVATLSCGHNVSVEELAQTRIYWLKDKKMVLTMISGDMNIWPEYKNRTIFDITNNLSIVILALRPSDEGTYECVVQKYEKDAFKWEHLAEVTLSVKAD

SEQ ID NO: 2239 - protein, 107 aa, Artificial Sequence
  CD80 v234 IgV
VIHVTKEVKEVATLSCGYNVSVEELAQTRIYWQKDKKMVLTMMSGDMNIWPEYKNRTIFDITNNLSIMILALRPSDEGTYECVVLKYEKDAFKREHQAEVTLSVKAD

SEQ ID NO: 2240 - protein, 107 aa, Artificial Sequence
  CD80 v235 IgV
VIHVTKEVKEVATLSCGHNVSVEELAQTRIYWLKDKKMVLTMMSGDLNIWPEYKNRTIFDITNNLSIMILALRPSDEGTYECVVQKYDKDAFKREHLAEVTLSVKAD

SEQ ID NO: 2241 - protein, 107 aa, Artificial Sequence
  CD80 v236 IgV
VIHVTKEVKEVATLSCGHNVSVEELAQTRIYWLKDKKMVLTMVSGDINIWPEYKNRTIFDITNNLSIVILGLRPSDEGTYECVVLKYEKDAFKREHLAEVTLSVKAD

SEQ ID NO: 2242 - protein, 107 aa, Artificial Sequence
  CD80 v237 IgV
VIHVTKEVKEVATLSCGHNVSVEELAQTRIYWQKDKKMVLTMMSGDLNIWPEYKNRTIFDITNNLSIVILGLRPSDEGTYECVVLKYEKDAFKREHQAEVTLSVKAD

SEQ ID NO: 2243 - protein, 107 aa, Artificial Sequence
  CD80 v238 IgV
VIHVTKEVKEVATLSCGHNVSVEELAQTRIYWQKDKKMVLTMMSGDVNIWPEYKNRTIFDITNNLSIVILGLRPSDEGTYECVVMKYEKDAFKREHQAEVTLSVKAD

SEQ ID NO: 2244 - protein, 107 aa, Artificial Sequence
  CD80 v239 IgV
VIHVTKEVKEVATLSCGYNVSVEELAQTRIHWQKDKKMVLTMMSGDVNIWPEYKNRTIFDITNNLSIVILGLRPSDEGTYECVVQKYEKDAFKREHLAEVTLSVKAD

SEQ ID NO: 2245 - protein, 107 aa, Artificial Sequence
  CD80 v240 IgV
VIHVTKEVKEVATLSCGHNVSVEELAQTRIYWQKDKKMVLTMMSGEVNIWPEYKNRTIFDITNNLSIVILALRPSDEGTYECVVLKYEKDAFKREHQAEVTLSVKAD

SEQ ID NO: 2246 - protein, 107 aa, Artificial Sequence
  CD80 v241 IgV
VIHVTKEVKEVATLSCGHNVSVEELAQTRIYWQKDKKMVLTMMSGVINIWPEYKNRTIFDITNNLSIVILGLRPSDEGTYECVVLKYEKDAVKREHLAEVTLSVKAD

SEQ ID NO: 2247 - protein, 107 aa, Artificial Sequence
  CD80 v242 IgV
VIHVTKEVKEVATLSCGHNVSVEELAQTRIYWQKDKKMVLTMMSGDVNIWPEYKNRTIFDIANNLSIVILGLRPSDEGTYECAVLKHEKDAFKREHMAEVTLSVKAD

SEQ ID NO: 2248 - protein, 107 aa, Artificial Sequence
  CD80 v243 IgV
VIHVTKEVKEVATLSCGHNVSVEELAQTRIYWLKDKKMVLTMMSGDMKIWPEYKNRTIFDITNNLSIVILALRPSDEGTYECVVQKYEKDAFKREHQAEVTLSVKAD

SEQ ID NO: 2249 - protein, 107 aa, Artificial Sequence
  CD80 v244 IgV
VIHVTKEVKEVATLSCGHNVSVEELAQTRIYWQKDKKMVLTMMSGDMNIWPEYKNRTIFDITNNLSIVILALRPSDEGTYECVVQKYEKDAFTRVHQAEVTLSVKAD

SEQ ID NO: 2250 - protein, 107 aa, Artificial Sequence
  CD80 v245 IgV
VIHVTKEVKEVATLSCGHNVSVEELAQTRIYWQKDKKMVLTMMSGDVKIWPEYKNRTIFDITNNLSIMILALRPSDEGTYECVVLKYENDAFKREHLAEVTLSVKAD

SEQ ID NO: 2251 - protein, 107 aa, Artificial Sequence
  CD80 v246 IgV
VIHVTKEVKEVATLSCGHNVSVEELAQTRIYWLKDKKMVLTMMSGDIDIWPEYKNRTIFDITNNLSIVILGLRPSDEGTYECVVLKYEKDAFKREHLAEVTLSVKAD

SEQ ID NO: 2252 - protein, 107 aa, Artificial Sequence
  CD80 v247 IgV
VIHVTKEVKEVATLSCGHNVSVEELAQTHIYWQKDKKMVLTMVSGDINVWPEYKNRTIFDITNNLSIVILALRPSDEGTYECVVLKYEKDAFKREHLAEVTLSVKAD

SEQ ID NO: 2253 - protein, 107 aa, Artificial Sequence
  CD80 v248 IgV
VIHVTKEVKEVATLSCGHNVSVEELAHTRIYWQKDKKMVLTMMSGDINIWPEYKNRTIFDITNNLSIVILALRPSDEGTYECVVQKYEKGAFKREHLAEVTLSVKAD

SEQ ID NO: 2254 - protein, 107 aa, Artificial Sequence
  CD80 v249 IgV
VIHVTKEVKEVATLSCGHNVSVEELAQTRIYWQKDKKMVLTMMSGDINIWPEYKNRTIFDITNNLSIVILALRPSDEGTYECVVQKYEKGAFKREHLAEVTLSVKAD

SEQ ID NO: 2255 - protein, 107 aa, Artificial Sequence
  CD80 v250 IgV
VIHVTKEVKEVATLSCGHNVSVEELAQTRIYWQKDKKMVLTMMSGDINIWPEYKNRTIFDISNNLSIVILALRPSDEGTYECVVQKYEKDAFKREHLAEVTLSVKAD

SEQ ID NO: 2256 - protein, 107 aa, Artificial Sequence
  CD80 v251 IgV
VIHVTKEVKEVATLSCGHNVSVEELEQTRIYWQKDKKMVLTMMSGDLNIWPEYKNRTIFDITNNLSIVILGLRPSDEGTYECVVLKYEKDAFKREHLAEVTLSVKAD

SEQ ID NO: 2257 - protein, 107 aa, Artificial Sequence
  CD80 v252 IgV
VIHVTKEVKEVATLSCGHNVSVEELAQTRIYWQKDKKMVLTMMSGDINIWPEYKNRTIFDITNNLSIVILALRPSDEGTYECVVLKQEEDAFKREHLAEVTLSVKAD

SEQ ID NO: 2258 - protein, 107 aa, Artificial Sequence
  CD80 v253 IgV
VIHVTKEVKEVATLSCGHNVSAEELAQTRIYWQKDKKMVLTMMSGDINIWPEYKNRTIFDITNNLSIVILALRPSDEGTYECVVLKNEKDAFKREHLAEVTLSVKAD

SEQ ID NO: 2259 - protein, 107 aa, Artificial Sequence
  CD80 v254 IgV
VIHVTKEVKEVATLSCGYNVSVEELEQTRIYWQKDKKMVLTMMSGDLNIWPEYKNRTIFDITNNLSIVILALRPSDEGTYECVVQKYEKGAFKREHLAEVTLSVKAD

SEQ ID NO: 2260 - protein, 107 aa, Artificial Sequence
  CD80 v255 IgV
VIHVTKEVKEVATLSCGHNVSVEELAQTRIYWQKDKKMVLTMMSGDLNIWPEYKNRTIFDITNNLSIVILGLRPSDEGTYECVVQKYEKDAFKREHLAEVTLSVKAD

SEQ ID NO: 2261 - protein, 107 aa, Artificial Sequence
  CD80 v256 IgV
VIHVTKEVKEVATLSCGHNVSVEELAQTRIYWQKDKKMVLTMMSGDVNIWPEYKNRTIFDITNNLSIVILGLRPSDEGTYECVVLKYDKDAFKREHLAEVTLSVKAD

SEQ ID NO: 2262 - protein, 107 aa, Artificial Sequence
  CD80 v257 IgV
VIHVTKEVKEVATLSCGHNVSVEELAQTRIYWQKDKKMVLTMMSGDMNIWPEYKNRTIFDITNNLSIVILGLRPSDEGTYECVVLKYEKDAFKREHLAEVTLSVKAD

SEQ ID NO: 2263 - protein, 107 aa, Artificial Sequence
  CD80 v258 IgV
VIHVTKEVKEVATLSCGHNVSVEELAQTRIYWQKDKKMVLTMMSGDVNIWPEYKNRTIFDITNNLSIVILGLRPSDEGTYECVVLKYEKDAFKREHLAEVTLSVKAD

SEQ ID NO: 2264 - protein, 107 aa, Artificial Sequence
  CD80 v259 IgV
VIHVTKEVKEVATLSCGHNVSVEELAQTRVYWQKDKKMVLTMMSGDVNIWPEYKNRTIFDITNNLSIVILGLRPSDEGTYECVVLKYEKDVFKREHLAEVTLSVKAD

SEQ ID NO: 2265 - protein, 107 aa, Artificial Sequence
  CD80 v260 IgV
VIHVTKEVKEVATLSCGHNVSVEELAQTRVCWQKDKKMVLTMMSGDVNIWPEYKNRTIFDITNNLSIVILGLRPSDEGTYECVVMKYEKDAFKREHLAEVTLSVKAD

SEQ ID NO: 2266 - protein, 107 aa, Artificial Sequence
  CD80 v261 IgV
VIHVTKEVKEVATLSCGHNVSDEELAQTRIYWQKDKKMVLTMMSGDLNIWPEYKNRTIFDITNNLSIVILALRPSDEGTYECVVQKYEKDAFKREHLAEVTLSVKAD

SEQ ID NO: 2267 - protein, 107 aa, Artificial Sequence
  CD80 v262 IgV
VIHVTKEVKEVATLSCGYNVSVEELAQTRIYWQKDKKMVLTMMSGDMKIWPEYKNRTIFDITNNLSIVILALRPSDEGTYECVVLKYEKDAFKREHLAEVTLSVKAD

SEQ ID NO: 2268 - protein, 107 aa, Artificial Sequence
  CD80 v263 IgV
VIHVTKEVKEVATLSCGHNVSVEELAQTRIYWQKDKKMVLSMMSGDVNIWPEYKNRTIFDITNNLSIVILGLRPSDEGTYECVVLKYENDAFKREHLAEVTLSVKAD

SEQ ID NO: 2269 - protein, 107 aa, Artificial Sequence
  CD80 v264 IgV
VIHVTKEVKEVATLSCGHNVSVEELAQTRIYWQKDKKMVLTMMSGDVTIWPEYKNRTIFDITNNLSIVILALRPSDEGTYECVVQKYEKDAFKREHLAEVTLSVKAD

SEQ ID NO: 2270 - protein, 107 aa, Artificial Sequence
  CD80 v265 IgV
VIHVTKEVKEVATLSCGHNVSVEELAQTRIYWQKDKKMVLTMMSGEVNIWPEYKNRTIFDITNNLSIVILDLRPSDEGTYECVVLKYEKGAFKREHLAEVTLSVKAD

SEQ ID NO: 2271 - protein, 107 aa, Artificial Sequence
  CD80 v266 IgV
VIHVTKEVKEVATLSCGHNVSVEELAQTRIYWQKDKKMVLTMMSGEVNIWPEYKNRTIFDITNNLSIVILDLRPSDEGTYECVVLKYEKDAFKREHLAEVTLSVKAD

SEQ ID NO: 2272 - protein, 107 aa, Artificial Sequence
  CD80 v267 IgV
VIHVTKEVKEVATLSCGHNVSVEELAQTRIYWQKDKKMVLSMISGDMNIWPEYKNRTIFDITNNLSIVILGLRPSDEGTYECVVLKYEKGAFKREHLAEVTLSVKAD

SEQ ID NO: 2273 - protein, 107 aa, Artificial Sequence
  CD80 v268 IgV
VIHVTKEVKEVATLSCGHNVSVEELAQTRIYWQKDKKMVLSMISGDVNIWPEYKNRTIFDITNNLSIVILGLRPSDEGTYECVVLKYEKDAFKREHLAEVTLSVKAD

SEQ ID NO: 2274 - protein, 107 aa, Artificial Sequence
  CD80 v269 IgV
VIHVTKEVKEVATLSCGHNVSVEELAQTRIYWQKDKKMVLSMISGDLNIWPEYKNRTIFDITNNLSIVILGLRPSDEGTYECVVLKYEKDAFKREHLAEVTLSVKAD

SEQ ID NO: 2275 - protein, 107 aa, Artificial Sequence
  CD80 v270 IgV
VIHVTKEVKEVATLSCGYNVSAEELAQTRIYWQKDKKMVLTMMSGDVNIWPEYKNRTIFDISNNLSIVILGLRPSDEGTYECVVLKYEKDAFKREHLAEVTLSVKAD

SEQ ID NO: 2276 - protein, 107 aa, Artificial Sequence
  CD80 v271 IgV
VIHVTKEVKEVATLSCGYNVSVEELEQTRIYWQKDKKMVLTMMSGDLNIWPEYKNRTIFDITNNLSIMILGLRPSDEGTYECVVLKYEKGAFKREHLAEVTLSVKAD

SEQ ID NO: 2277 - protein, 107 aa, Artificial Sequence
  CD80 v272 IgV
VIHVTKEVKEVATLSCGHNVSVEELAQTRIYWQKDKEMVLTMMSGDVDIWPEYKNRTIFDITNNLSIVILALRPSDEGTYECVVQKYEKNAFKREHLAEVTLSVKAD

SEQ ID NO: 2278 - protein, 107 aa, Artificial Sequence
  CD80 v273 IgV
VIHVTKEVKEVATLSCGHNVSVEELAHTRIYWQKDKKMVLTMMSGVLNIWPEYKNRTIFDITNNLSIVILGLRPSDEGTYECVVLKYEKDAFKREHLAEVTLSVKAD

SEQ ID NO: 2279 - protein, 107 aa, Artificial Sequence
  CD80 v274 IgV
VIHVTKEVKEVATLSCGHNVSLEELAHTRIYWQKDKKMVLTMMSGDINIWPEYKNRTIFDITNNLSIVILGLRPSDEGTYECVVLKYEKDAFKREHLAEVTLSVKAD

SEQ ID NO: 2280 - protein, 107 aa, Artificial Sequence
  CD80 v275 IgV
VIHVTKEVKEVATLSCGHNVSVEELAQTRIYWQKDKKMVLTMMSGVLNIWPEYKNRTIFDITNNLSIMILALRPSDEGTYECVVQKYDKDAFKREHLAEVTLSVKAD

SEQ ID NO: 2281 - protein, 107 aa, Artificial Sequence
  CD80 v276 IgV
VIHVTKEVKEVATLSCGHNVSVEELAQTRIYWQKDKKMVLSMVSGDINIWPEYKNRTIFDITNNLSIVIMGLRPSDEGTYECVVLKYEKDAFKREHLAEVTLSVKAD

SEQ ID NO: 2282 - protein, 107 aa, Artificial Sequence
  CD80 v277 IgV
VIHVTKEVKEVATLSCGHNVSVEELAQTRIYWQKDKKMVLTMMSGEVNIWPEYKNRTIFDITDNLSIVILALRPSDEGTYECVVQKYEKDAFKREHLAEVTLSVKAD

SEQ ID NO: 2283 - protein, 107 aa, Artificial Sequence
  CD80 v278 IgV
VIHVTKEVKEVATLSCGHNVSVEELAQTRIYWQKDKKMVLTMMSGDVNIWPEYKNRTIFDIANNLSIVILDLRPSDEGTYECVVLKYEKDAFEREHLAEVTLSVKAD

SEQ ID NO: 2284 - protein, 107 aa, Artificial Sequence
  CD80 v279 IgV
VIHVTKEVKEVATLSCGHNVSVEELAQTRIYWQKDKKMVLTMMSGEVNIWPEYKNRTIFDITNNLSIMILALRPSDEGTYECVVLKYEKGAFEREHLAEVTLSVKAD

SEQ ID NO: 2285 - protein, 107 aa, Artificial Sequence
  CD80 v280 IgV
VIHVTKEVKEVATLSCGHNVSVEELAQTRIYWQKDKKMVLTMISGDVNIWPEYKNRTIFDITNNLSIVILALRPSDEGTYECVVLKYENDAFKREHLAEVTLSVKAD

SEQ ID NO: 2286 - protein, 107 aa, Artificial Sequence
  CD80 v281 IgV
VIHVTKEVKEVATLSCGHNVSVEELAQTRIYWQKDKKMVLTMMSGDLNIWPEYKNRTIFDITNNLSIVILGLRPSDEGTYECVVMKYEKDAYKREHLAEVTLSVKAD

SEQ ID NO: 2287 - protein, 107 aa, Artificial Sequence
  CD80 v282 IgV
VIHVTKEVKEVATLSCGHNVSVEELAQTRIYWQKDKKMVLTVMSGDVNIWPDYKNRTIFDITNNLSIVILALRPSDEGTYECVVQKYEKDAFKREHLAEVTLSVKAD

SEQ ID NO: 2288 - protein, 107 aa, Artificial Sequence
  CD80 v283 IgV
VIHVTKEVKEVATLSCGHNVSDEELAQTRIYWQKDKKMVLTMMSGDLNIWPEYKNRTIFDITNNLSIVIMALRPSDEGTYECVVLKYEKDAFKREHQAEVTLSVKAD

SEQ ID NO: 2289 - protein, 107 aa, Artificial Sequence
  CD80 v284 IgV
VIHVTKEVKEVATLSCGHNVSVEELAQTRIYWQKDKKMVLSMMSGDVNIWPEYKNRTIFDITNNLSIVILALRPSDEGTYECVVLKYEKDAFKREHQAEVTLSVKAD

SEQ ID NO: 2290 - protein, 107 aa, Artificial Sequence
  CD80 v285 IgV
VIHVTKEVKEVATLSCGHNVSVEELAQTRIYWQKDKKMVLTMMSGDMNIWPEHKNRTIFDITNNLSIVILGLRPSDEGTYECVVLKYEKGAFKREHRAEVTLSVKAD

SEQ ID NO: 2291 - protein, 107 aa, Artificial Sequence
  CD80 v286 IgV
VIHVTKEVKEVATLSCGHNVSVEELAQTRIYWQKDKKMVLTMMSGDMNIWPEYKNRTIFDITNNLSIVILDVHPSDEGTYKCVVLKYEKDAFKREHLAEVTLSVKAD

SEQ ID NO: 2292 - protein, 107 aa, Artificial Sequence
  CD80 v287 IgV
VIHVTKEVKEVATLSCGHNVSVEELAQTRIYWLKDKKMVLTMISGDMNIWPEFKNRTIFDISNNLSIVILALRPSDEGTYECVVQKYEKDAFKREHLAEVTLSVKAD

SEQ ID NO: 2293 - protein, 107 aa, Artificial Sequence
  CD80 v288 IgV
VIHVTKEVKEVATLSCGHNVSVEELAQTRIYWQKDKKTVLTMMSGEVSIWPEYKNRTIFDITNNLSIVILALRPSDEGTYECVVLKYEKDAFKREHLAEVTLSVKAD

SEQ ID NO: 2294 - protein, 107 aa, Artificial Sequence
  CD80 v289 IgV
VIHVTKEVKEVATLSCGHNVSVEELAQTRIYWRKDKKMVLTMMSGDVKIWPEYKNRTIFDITNNLSIVILALRPSDEGTYECVVMKYEKDALKREHLAEVTLSVKAD

SEQ ID NO: 2295 - protein, 107 aa, Artificial Sequence
  CD80 v290 IgV
VIHVTKEVKEVATLSCGHNVSVEELAQTRIYWQKDKKTVLTMVSGDVRIWPEYKNRTIFDITNNLSIVILALRPSDEGTYECVVQKYEKDAFKREHLAEVTLSVKAD

SEQ ID NO: 2296 - protein, 107 aa, Artificial Sequence
  CD80 v291 IgV
VIHVTKEVKEVATLSCGHNVSVEELAQYRIYWHKDKKMVLTMMSGVINIWPEYKNRTIFDITNNLSIVILGLRPSDEGTYECVVLKYEKDAFKREHLAEVTLSVKAD

SEQ ID NO: 2297 - protein, 208 aa, Artificial Sequence
  CD80 v292 ECD
VIHVTKEVKEVATLSCGHNVSVEELAQTRIYWQKDKKMVLTMMSGDMKIWPEYKNRTIFDITNNLSIVILAVRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2298 - protein, 208 aa, Artificial Sequence
  CD80 v293 ECD
VIHVTKEVKEVATLSCGHNVSVEELAQTRIYWQKDKKMVLSMMSGDMTIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2299 - protein, 208 aa, Artificial Sequence
  CD80 v294 ECD
VIHVTKEVKEVATLSCGHNVSVEELAQTRIYWQKEKKMVLTMMSGVINIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2300 - protein, 208 aa, Artificial Sequence
  CD80 v295 ECD
VIHVTKEVKEVATLSCGHNVSVEELAQTRIYWQKEKKMVLTMMSGDINIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2301 - protein, 208 aa, Artificial Sequence
  CD80 v296 ECD
VIHVTKEVKEVATLSCGHNVSVEELAQTRIYWQKDKKMVLTMISGDLNIWPEYKNRTIFDITNNLSIVILALRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2302 - protein, 208 aa, Artificial Sequence
  CD80 v297 ECD
VIHVTKEVKEVATLSCGHNVSVEELAQTRIYWQKDKKMVLTMISGEMNIWPEYKNRTIFDITNNLSIVILGLRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2303 - protein, 208 aa, Artificial Sequence
  CD80 v298 ECD
VIHVTKEVKEVATLSCGYNVSVEELAQTRIYWQKDKKMVLTMMSGDLNIWPEYKNRTIFDITNNLSIVILGLRPSDEGTYECVVLKYEKDSFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2304 - protein, 208 aa, Artificial Sequence
  CD80 v299 ECD
VIHVTKEVKEVATLSCGHNVSVEELAQTRIYWQKDKKMVLTMMSGDIKIWPEYKNRTIFDFTNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2305 - protein, 208 aa, Artificial Sequence
  CD80 v300 ECD
VIHVTKEVKEVATLSCGHNVSVEELAQTRIYWQKDKKMVLTMMSGDVNIWPEYKNRTIFDISNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2306 - protein, 208 aa, Artificial Sequence
  CD80 v301 ECD
VIHVTKEVKEVATLSCGHNVSVEELAQTRIYWQKEKKMVLTMISGDLNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2307 - protein, 208 aa, Artificial Sequence
  CD80 v302 ECD
VIHVTKEVKEVATLSCGHNVSVEELAQTRIYWQKDKKMVLTMMSGDVNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2308 - protein, 208 aa, Artificial Sequence
  CD80 v303 ECD
VIHVTKEVKEVATLSCGHNVSVEELAQTRIYWQKDKKMVLTMMSGDLNIWPEYKNRTIFDITNNLSIVILGLRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2309 - protein, 208 aa, Artificial Sequence
  CD80 v304 ECD
VIHVTKEVKEVATLSCGHNVSAEELAQTRIYWQKDKKMVLTMMSGDLNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2310 - protein, 208 aa, Artificial Sequence
  CD80 v305 ECD
VIHVTKEVKEVATLSCGHNVSVEELAQTRIYWQKDKKMVLTMMSGDLNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2311 - protein, 208 aa, Artificial Sequence
  CD80 v306 ECD
VIHVTKEVKEVATLSCGHNVSVEELAQTRIYWQKDKKMVLTMMSGEINIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2312 - protein, 208 aa, Artificial Sequence
  CD80 v307 ECD
VIHVTKEVKEVATLSCGHNVSVEELAHTRIYWQKDKKMVLTMMSGDINIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2313 - protein, 208 aa, Artificial Sequence
  CD80 v308 ECD
VIHVTKEVKEVATLSCGHNVSVEELAQTRIYWQKDKKMVLTMMSGEMNIWPEYKNRTIFDITNNLSIVILALRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2314 - protein, 208 aa, Artificial Sequence
  CD80 v309 ECD
VIHVTKEVKEVATLSCGHNVSVEELAQTRIYWQKDKKMVLTMMSGEMNIWPEYKNRTIFDITNNLSIVILALRPSDEGTYECVVLKYEKDGFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2315 - protein, 208 aa, Artificial Sequence
  CD80 v310 ECD
VIHVTKEVKEVATLSCGHNVSVEELAQTRIYWQKDKKMVLTMMSGEMNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2316 - protein, 208 aa, Artificial Sequence
  CD80 v311 ECD
VIHVTKEVKEVATLSCGHNVSVEELAQTRIYWQKDKKMVLTMMSGDMNIWPEYKNRTIFDITNNLSIVILALRPSDEGTYECVVLKYEKDAFKREHRAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2317 - protein, 208 aa, Artificial Sequence
  CD80 v312 ECD
VIHVTKEVKEVATLSCGYNVSVEELAQTRIYWQKDKKMVLTMMSGDMNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2318 - protein, 208 aa, Artificial Sequence
  CD80 v313 ECD
VIHVTKEVKEVATLSCGHNVSVEELALTRIYWQKDKKMVLTMMSGDVNIWPEYKNRTIFDVTNNLSIVILALRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2319 - protein, 208 aa, Artificial Sequence
  CD80 v314 ECD
VIHVTKEVKEVATLSCGHNVSVEELAQTRIYWQKDKKMVLTMMSGDVNIWPEYKNRTIFDVTNNLSIVILALRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2320 - protein, 208 aa, Artificial Sequence
  CD80 v315 ECD
VIHVTKEVKEVATLSCGHNVSVEELAQTRIYWQKDKKMVLTMMSGDVNIWPEYKNRTIFDITNNLSIVILALRPSDEGTYECVVMKYEKDAFKQEHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2321 - protein, 208 aa, Artificial Sequence
  CD80 v316 ECD
VIHVTKEVKEVATLSCGHNVSVEELAQTRIYWQKDKKMVLTMMSGDVKIWPEYKNRTIFDITNNLSIVILALRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2322 - protein, 208 aa, Artificial Sequence
  CD80 v317 ECD
VIHVTKEVKEVATLSCGYNVSVEELAQTRIYWQKDKKMVLTMMSGDVKIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2323 - protein, 208 aa, Artificial Sequence
  CD80 v318 ECD
VIHVTKEVKEVATLSCGHNVSVEELERTRIYWQKDKKMVLTMMSGDLYIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2324 - protein, 208 aa, Artificial Sequence
  CD80 v319 ECD
VIHVTKEVKEVATLSCGHNVSVEELAQTRIYWQKDKKMVLTMMSGELNIWPEYKNRTIFDITNNLSIMILALRPSDEGTYECVVQKYEKDALKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2325 - protein, 208 aa, Artificial Sequence
  CD80 v320 ECD
VIHVTKEVKEVATLSCGHNVSVEELAQTRIYWQKDKKMVLTMMSGDINIWPEYKNRTIFDISNNLSIVILALRPSDEGTYECVVQKYDKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2326 - protein, 208 aa, Artificial Sequence
  CD80 v321 ECD
VIHVTKEVKEVATLSCGHNVSVEDLARTRIYWQKDKKMVLSMMSGDVNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2327 - protein, 208 aa, Artificial Sequence
  CD80 v322 ECD
VIHVTKEVKEVATLTCGYNVSVEELAQTRIYWQKDKKMVLTMMSGDVNIWPEYKNRTIFDIANSLSIVILGLRPSDEGTYECVVQKYEKNAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2328 - protein, 208 aa, Artificial Sequence
  CD80 v323 ECD
VIHVTKEVKEVATLSCGHNVSVEELAQTRIYWQKDKKMVLTMMSGDLNIWPEYKNRTIFDITNNLSIMILGLRPSDEGTYECVVQKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2329 - protein, 208 aa, Artificial Sequence
  CD80 v324 ECD
VIHVTKEVKEVATLSCGYNVSVEELAQTRIYWQKDKKMVLTMMSGDINIWPEYKNRTIFDITNNLSIMILGLRPSDEGTYECVVLKYEKDAFKLEHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2330 - protein, 119 aa, Artificial Sequence
  CD80 v325 ECD
VIHVTKEVKEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2331 - protein, 208 aa, Artificial Sequence
  CD80 v326 ECD
VIHVTKEVKEVATLSCGHNVSVEELAQTRIYWRKEKKMVLTMMSGDVNIWPEYKNRTIFDINNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2332 - protein, 208 aa, Artificial Sequence
  CD80 v327 ECD
VIHVTKEVKEVATLSCGYNVSAEELAQTRIYWQKDKKMVLSMMSGDVNIWPEYKNRTIFDINNNLSIVILGLRPSDEGTYECVVLKYEKDGFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2333 - protein, 208 aa, Artificial Sequence
  CD80 v328 ECD
VIHVTKEVKEVATLSCGHNVSVEELAQTRIYWQKDKKMVLTMMSGDLNIWPEYKNRTIFDITNNLSIVIMALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2334 - protein, 208 aa, Artificial Sequence
  CD80 v329 ECD
VIHVTKEVKEVATLSCGHNVSVEELAQTRIYWQKDKKMVLTMMSGDLNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2335 - protein, 208 aa, Artificial Sequence
  CD80 v330 ECD
VIHVTKEVKEVATLSCGHNVSVEELAQTRIYWQKDKKMVLTMMSGVLNIWPEYKNRTIFDITNNLSIMILALRPSDEGTYECVVLKYDKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2336 - protein, 208 aa, Artificial Sequence
  CD80 v331 ECD
VIHVTKEVKEVATLSCGHNVSVEELAQTRIYWQKDKKMVLTMMSGVLNIWPEYKNRTIFDITNNLSIMILALRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2337 - protein, 208 aa, Artificial Sequence
  CD80 v332 ECD
VIHVTKEVKEVATLSCGHNVSVEELAQTRIYWQKDKKMVLTMMSGVLNIWPEYKNRTIFDITNNLSIMILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2338 - protein, 208 aa, Artificial Sequence
  CD80 v333 ECD
VIHVTKEVKEVATLSCGHNVSVEELAQTRIYWQKDKKMVLTMMSGVLNIWPEYKNRTIFDITNNLSIMILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2339 - protein, 208 aa, Artificial Sequence
  CD80 v334 ECD
VIHVTKEVKEVATLSCGHNVSVEELAQTRIYWQKDKKMVLTMMSGVLNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2340 - protein, 208 aa, Artificial Sequence
  CD80 v335 ECD
VIHVTKEVKEVATLSCGHNVSVEELAQTRIYWQKDKKMVLTMMSGVLNIWPEYKNRTIFDITNNLSIVIMALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2341 - protein, 208 aa, Artificial Sequence
  CD80 v336 ECD
VIHVTKEVKEVATLSCGHNVSVEELAQTRIYWQKDKKMVLTMMSGVLNIWPEYKNRTIFDITNNLSIVIMALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2342 - protein, 208 aa, Artificial Sequence
  CD80 v337 ECD
VIHVTKEVKEVATLSCGHNVSVEELAQTRIYWQKDKKMVLTMMSGDVKIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2343 - protein, 208 aa, Artificial Sequence
  CD80 v338 ECD
VIHVTKEVKEVATLSCGHNVSVEDLAQTRIYWQKDKKMVLTMMSGDLNIWPEYKNRTIFDITNNLSIMILALRPSDEGTYECVVLKYEKDAFKRVHQAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2344 - protein, 208 aa, Artificial Sequence
  CD80 v339 ECD
VIHVTKEVKEVATLSCGHNVSVEELAQTRIYWQKDKKMVLTMMSGEINIWPEYKNRTIFDIANNLSIMILALRPSDEGTYECVVMKCEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2345 - protein, 208 aa, Artificial Sequence
  CD80 v340 ECD
VIHVTKEVKEVATLSCGHNVSVEELAQTRIYWQKDKKMVLTMMSGEINIWPEYKNRTIFDITNNLSIMILALRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2346 - protein, 208 aa, Artificial Sequence
  CD80 v341 ECD
VIHVTKEVKEVATLSCGHNVSVEELAQTRIYWQKDKKMVLTMMSGELNIWPEYKNRTIFDITNNLSIMILGLRPSDEGTYECVVLKCEKDAFRREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2347 - protein, 208 aa, Artificial Sequence
  CD80 v342 ECD
VIHVTKEVKEVATLSCGHNVSVEELAQTRIYWQKDKKMVLTMMSGELNIWPEYKNRTIFDITNNLSIMILALRPSDEGMYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2348 - protein, 208 aa, Artificial Sequence
  CD80 v343 ECD
VIHVTKEVKEVATLSCGHNVSVEELAQTRIYWQKDKKMVLTMMSGELNIWPEYKNRTIFDITNNLSIMILALRPSDEGMYECVVMKYEKDAFKREHQAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2349 - protein, 208 aa, Artificial Sequence
  CD80 v344 ECD
VIHVTKEVKEVATLSCGHNVSVEELAQTRIYWQKDKKMVLTMMSGEVNIWPEYKNRTIFDITNNLSIMILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2350 - protein, 208 aa, Artificial Sequence
  CD80 v345 ECD
VIHVTKEVKEVATLSCGHNVSVEELAQTRIYWQKDKKMVLTMISGDLNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2351 - protein, 208 aa, Artificial Sequence
  CD80 v346 ECD
VIHVTKEVKEVATLSCGHNVSVEELAQTRIYWQKDKKMVLTMMSGDINIWPEYKNRTIFDITNNLSIMILALRPSDEGTYECVVLKNEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2352 - protein, 208 aa, Artificial Sequence
  CD80 v347 ECD
VIHVTKEVKEVATLSCGHNVSVEELAQTRIYWQKDKKMVLTMMSGDLNIWPEYKNRTIFDITNNLSIMILALRPSDEGTYECVVLKYEKDAFKRVHQAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2353 - protein, 208 aa, Artificial Sequence
  CD80 v348 ECD
VIHVTKEVKEVATLSCGHNVSVEELAQTRIYWQKDKKMVLTMMSGDLNIWPEFKNRTIFDITNNLSIMILGLRPSDEGTYECVVLKYEKDAFRRVHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2354 - protein, 208 aa, Artificial Sequence
  CD80 v349 ECD
VIHVTKEVKEVATLSCGHNVSVEELAQTRIYWQKDKKMVLTMMSGDVKIWPEYKNRTIFDITNNLSIMILGLRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2355 - protein, 208 aa, Artificial Sequence
  CD80 v350 ECD
VIHVTKEVKEVATLSCGHNVSVEELAQTRIYWQKDKKMVLTMMSGDVKIWPEYKNRTIFDITNNLSIMILALRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2356 - protein, 208 aa, Artificial Sequence
  CD80 v351 ECD
VIHVTKEVKEVATLSCGHNVSVEELAQTRIYWQKDKKMVLTMMSGDVNIWPEYKNRTIFDITNNLSIMILALRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2357 - protein, 208 aa, Artificial Sequence
  CD80 v352 ECD
VIHVTKEVKEVATLSCGHNVSVEELAQTRIYWQKDKKMVLTMMSGDVNIWPEYKNRTIFDITNNLSIMILALRPSDEGTYECVVMKDEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2358 - protein, 208 aa, Artificial Sequence
  CD80 v353 ECD
VIHVTKEVKEVATLSCGHNVSVEELAQTRIYWQKDKKMVLSMMSGEINIWPEYKNRTIFDITNNLSIMILALRPSDEGTYECVVLKYEKDAFRRVHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2359 - protein, 208 aa, Artificial Sequence
  CD80 v354 ECD
VIHVTKEVKEVATLSCGYNVSVEELAQTRIYWQKDKKMVLTMMSGEINIWPEYKNRTIFDITNNLSIMILALRPSDEGTYECVVLKYEKDAFKLEHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2360 - protein, 208 aa, Artificial Sequence
  CD80 v355 ECD
VIHVTKEVKEVATLSCGYNVSVEELAQTRIYWQKDKKIVLTMMSGDLNIWPEYKNRTIFDITNNLSIMILALRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2361 - protein, 208 aa, Artificial Sequence
  CD80 v356 ECD
VIHVTKEVKEVATLSCGYNVSVEELAQTRIYWQKDKKMVLTMMSGDINIWPEYKNRTIFDITNNLSIMILALRPSDEGTYECVVLKNEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2362 - protein, 208 aa, Artificial Sequence
  CD80 v357 ECD
VIHVTKEVKEVATLSCGYNVSVEELAQTRIYWQKDKKMVLTMMSGDLNIWPEYKNRTIFDITNNLSIMILGLRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2363 - protein, 208 aa, Artificial Sequence
  CD80 v358 ECD
VIHVTKEVKEVATLSCGYNVSVEELAQTRIYWQKDKKMVLTMMSGDLNIWPEYKNRTIFDITNNLSIMILALRPSDEGTYECVVLKYEKDAFKRVHQAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2364 - protein, 208 aa, Artificial Sequence
  CD80 v359 ECD
VIHVTKEVKEVATLSCGYNVSVEELAQTRIYWQKDKKMVLTMMSGDLNIWPEFKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2365 - protein, 208 aa, Artificial Sequence
  CD80 v360 ECD
VIHVTKEVKEVATLSCGYNVSVEELAQTRIYWQKDKKMVLTMMSGDLNIWPEFKNRTIFDITNNLSIMILGLRPSDEGTYECVVLKYEKDAFRRVHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2366 - protein, 208 aa, Artificial Sequence
  CD80 v361 ECD
VIHVTKEVKEVATLSCGYNVSVEELAQTRIYWQKDKKMVLTMMSGDVNIWPEYKNRTIFDITNNLSIMILALRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2367 - protein, 208 aa, Artificial Sequence
  CD80 v362 ECD
VIHVTKEVKEVATLSCGYNVSVEELAQTRIYWQKDKKMVLTMMSGDMNIWPEYKNRTIFDITNNLSIMILGLRPSDEGTYECVVLKYEKDAFKQVHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2368 - protein, 208 aa, Artificial Sequence
  CD80 v363 ECD
VIHVTKEVKEVATLSCGYNVSVEELAQTRIYWQKDKKMVLTMMSGDMNIWPEYKNRTIFDITNNLSIMILALRPSDEGTYECVVMKYEKDAFKQEHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2369 - protein, 208 aa, Artificial Sequence
  CD80 v364 ECD
VIHVTKEVKEVATLSCGYNVSVEELAQTRIYWQKDKKMVLTMMSGDMNIWPEYKNRTIFDITNNLSIMILALRPSDEGMYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2370 - protein, 208 aa, Artificial Sequence
  CD80 v365 ECD
VIHVTKEVKEVATLSCGYNVSDEELAQTRIYWQKDKKMVLTMMSGDVKIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2371 - protein, 208 aa, Artificial Sequence
  CD80 v366 ECD
VIHVTKEVKEVATLSCGHNVSVEELALTRIYWLKDKKMVLSMMSGDVKIWPEYKNRTIFDITNNLSIMILALRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2372 - protein, 208 aa, Artificial Sequence
  CD80 v367 ECD
VIHVTKEVKEVATLSCGHNVSVEELAQTRIYWLKDKKMVLTMMSGDVNIWPEYKNRTIFDISNNLSIMILALRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2373 - protein, 208 aa, Artificial Sequence
  CD80 v368 ECD
VIHVTKEVKEVATLSCGHNVSVEELAQTRIYWRKDKKIVLTMMSGDLNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2374 - protein, 208 aa, Artificial Sequence
  CD80 v369 ECD
VIHVTKEVKEVATLSCGHNVSVEELAQTCIYWQKDKKMVLTMMSGDLNIWPEYKNRTIFDITNNLSIMILGLRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2375 - protein, 208 aa, Artificial Sequence
  CD80 v370 ECD
VIHVTKEVKEVATLSCGHNVPVEELAQTRIYWQKDKEMVLTMMSGEINIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2376 - protein, 208 aa, Artificial Sequence
  CD80 v371 ECD
VIHVTKEVKEVATLSCGHNVPVEELAQTRIYWQKDKEMVLTMMSGEINIWPEYKNRTIFDITNNLSIMILALRPSDEGTYECVVLKYEKDAFKLEHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2377 - protein, 208 aa, Artificial Sequence
  CD80 v372 ECD
VIHVTKEVKEVARLSCGHNVSVEELAQTRIYWQKDKKMVLTMMSGDLNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2378 - protein, 208 aa, Artificial Sequence
  CD80 v373 ECD
VIHVTKEVKEVARLSCGYNVSVEELAQTRIYWQKDKKMVLTMMSGDMNIWPEYKNRTIFDITNNLSIMILALRPSDEGTYECVVMKYEKDAFKQEHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2379 - protein, 208 aa, Artificial Sequence
  CD80 v374 ECD
VIHVTKEVKEVARLSCGHNVSVEELALTRIYWLKDKKMVLSMMSGDVKIWPEYKNRTIFDITNNLSIMILALRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2380 - protein, 208 aa, Artificial Sequence
  CD80 v375 ECD
VIHVTKEVKEVARLSCGHNVSVEELAQTRIYWLKDKKMVLTMMSGDLNIWPEYKNRTIFDITNNLSIMILALRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2381 - protein, 208 aa, Artificial Sequence
  CD80 v376 ECD
VIHVTKEVKEVARLSCGHNVSVEELAQTRIYWLKDKKMVLTMMSGDVNIWPEYKNRTIFDISNNLSIMILALRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2382 - protein, 208 aa, Artificial Sequence
  CD80 v377 ECD
VIHVTKEVKEVARLSCGHNVSVEELAQTRIYWRKDKKIVLTMMSGDLNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2383 - protein, 208 aa, Artificial Sequence
  CD80 v378 ECD
VIHVTKEVKEVARLSCGHNVSVEELAQTRIYWRKDKKIVLTMMSGDLNIWPEYKNRTIFDITNNLSIMILALRPSDEGTYECVVLKYEKDAFKRVHQAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2384 - protein, 208 aa, Artificial Sequence
  CD80 v379 ECD
VIHVTKEVKEVARLSCGHNVSVEELAQTRIYWRKDKKIVLTMMSGDLNIWPEYKNRTIFDITNNLSIMILALRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2385 - protein, 208 aa, Artificial Sequence
  CD80 v380 ECD
VIHVTKEVKEVARLSCGHNVSVEELAQTRIYWRKDKKIVLTMMSGDLNIWPEYKNRTIFDITNNLSIMILALRPSDEGTYECVVMKYEKDAFKQEHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2386 - protein, 208 aa, Artificial Sequence
  CD80 v381 ECD
VIHVTKEVKEVARLSCGHNVSVEELAQTRIYWRKDKKMVLTMMSGDLNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2387 - protein, 208 aa, Artificial Sequence
  CD80 v382 ECD
VIHVTKEVKEVARLSCGHNVSVEELAQTRIYWRKDKKMVLTMMSGDLNIWPEYKNRTIFDITNNLSIMILALRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2388 - protein, 208 aa, Artificial Sequence
  CD80 v383 ECD
VIHVTKEVKEVATLSCGHNVSDEDLAQTRIYWQKDKKMVLTMMSGDLNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2389 - protein, 208 aa, Artificial Sequence
  CD80 v384 ECD
VIHVTKEVKEVATLSCGHNVSDEDLAQTRIYWQKDKKMVLTMMSGDLNIWPEYKNRTIFDITNNLSIMILALRPSDEGTYECVVMKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2390 - protein, 208 aa, Artificial Sequence
  CD80 v385 ECD
VIHVTKEVKEVATLSCGHNVSDEDLAQTRIYWQKDKKMVLTMMSGDVNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2391 - protein, 208 aa, Artificial Sequence
  CD80 v386 ECD
VIHVTKEVKEVATLSCGHNVSVEELAQTRIYWQKEKKMVLTMMSGVMNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2392 - protein, 208 aa, Artificial Sequence
  CD80 v387 ECD
VIHVTKEVKEVATLSCGHNVSVEELAQTRIYWQKEKKMVLTMMSGDLNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2393 - protein, 208 aa, Artificial Sequence
  CD80 v388 ECD
VIHVTKEVKEVATLSCGHNVSVEELAQTRIYWQKEKKMVLTMMSGDMNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2394 - protein, 208 aa, Artificial Sequence
  CD80 v389 ECD
VIHVTKEVKEVATLSCGHNVSVEELAQTRIYWQKEKKMVLTMMSGDMNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2395 - protein, 208 aa, Artificial Sequence
  CD80 v390 ECD
VIHVTKEVKEVATLSCGHNVSVEELAQTRIYWQKDKKMVLTMMSGVMNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2396 - protein, 208 aa, Artificial Sequence
  CD80 v392 ECD
VIHVTKEVKEVATLSCGHNVSVEELAQTRIYWQKDKKMVLTMMSGDMNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2397 - protein, 208 aa, Artificial Sequence
  CD80 v393 ECD
VIHVTKEVKEVATLSCGHNVSVEELAQTRIYWQKDKKMVLTMMSGDMNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2398 - protein, 208 aa, Artificial Sequence
  CD80 v394 ECD
VIHVTKEVKEVATLSCGHNVSVEELAQTRIYWQKEKKMVLTMMSGVLNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2399 - protein, 208 aa, Artificial Sequence
  CD80 v395 ECD
VIHVTKEVKEVATLSCGHNVSVEELAQTRIYWQKEKKMVLTMMSGVMNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2400 - protein, 208 aa, Artificial Sequence
  CD80 v396 ECD
VIHVTKEVKEVATLSCGHNVSVEELAQTRIYWQKEKKMVLTMMSGVMNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2401 - protein, 208 aa, Artificial Sequence
  CD80 v397 ECD
VIHVTKEVKEVATLSCGHNVSVEELAQTRIYWQKEKKMVLTMMSGDLNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2402 - protein, 208 aa, Artificial Sequence
  CD80 v398 ECD
VIHVTKEVKEVATLSCGHNVSVEELAQTRIYWQKEKKMVLTMMSGDLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2403 - protein, 208 aa, Artificial Sequence
  CD80 v399 ECD
VIHVTKEVKEVATLSCGHNVSVEELAQTRIYWQKEKKMVLTMMSGDMNIWPEYKNRTIFDITNNLSIMILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2404 - protein, 208 aa, Artificial Sequence
  CD80 v400 ECD
VIHVTKEVKEVATLSCGHNVSVEELAQTRIYWQKDKKMVLTMMSGVLNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2405 - protein, 208 aa, Artificial Sequence
  CD80 v401 ECD
VIHVTKEVKEVATLSCGHNVSVEELAQTRIYWQKDKKMVLTMMSGVMNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2406 - protein, 208 aa, Artificial Sequence; identical to SEQ ID NO: 55
  CD80 v402 ECD

SEQ ID NO: 2407 - protein, 208 aa, Artificial Sequence
  CD80 v403 ECD
VIHVTKEVKEVATLSCGHNVSVEELAQTRIYWQKDKKMVLTMMSGDMNIWPEYKNRTIFDITNNLSIMILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2408 - protein, 208 aa, Artificial Sequence
  CD80 v404 ECD
VIHVTKEVKEVATLSCGHNVSVEELAQTRIYWQKEKKMVLTMMSGVLNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2409 - protein, 208 aa, Artificial Sequence
  CD80 v405 ECD
VIHVTKEVKEVATLSCGHNVSVEELAQTRIYWQKEKKMVLTMMSGVLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2410 - protein, 208 aa, Artificial Sequence
  CD80 v406 ECD
VIHVTKEVKEVATLSCGHNVSVEELAQTRIYWQKEKKMVLTMMSGVMNIWPEYKNRTIFDITNNLSIMILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2411 - protein, 208 aa, Artificial Sequence
  CD80 v407 ECD
VIHVTKEVKEVATLSCGHNVSVEELAQTRIYWQKEKKMVLTMMSGDLNIWPEYKNRTIFDITNNLSIMILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2412 - protein, 208 aa, Artificial Sequence
  CD80 v408 ECD
VIHVTKEVKEVATLSCGHNVSVEELAQTRIYWQKDKKMVLTMMSGVLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2413 - protein, 208 aa, Artificial Sequence
  CD80 v409 ECD
VIHVTKEVKEVATLSCGHNVSVEELAQTRIYWQKDKKMVLTMMSGVMNIWPEYKNRTIFDITNNLSIMILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2414 - protein, 208 aa, Artificial Sequence
  CD80 v410 ECD
VIHVTKEVKEVATLSCGHNVSVEELAQTRIYWQKDKKMVLTMMSGDLNIWPEYKNRTIFDITNNLSIMILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2415 - protein, 208 aa, Artificial Sequence
  CD80 v411 ECD
VIHVTKEVKEVATLSCGHNVSVEELAQTRIYWQKEKKMVLTMMSGVLNIWPEYKNRTIFDITNNLSIMILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2416 - protein, 208 aa, Artificial Sequence
  CD80 v412 ECD
VIHVTKEVKEVATLSCGHNVSVEELAQTRIYWQKEKKMVLTMMSGDVNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2417 - protein, 208 aa, Artificial Sequence
  CD80 v413 ECD
VIHVTKEVKEVATLSCGHNVSVEELAQTRIYWQKEKKMVLTMMSGDMKIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2418 - protein, 208 aa, Artificial Sequence
  CD80 v414 ECD
VIHVTKEVKEVATLSCGHNVSVEELAQTRIYWQKEKKMVLTMMSGDMNIWPEYKNRTIFDITNNLSIVILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2419 - protein, 208 aa, Artificial Sequence
  CD80 v415 ECD
VIHVTKEVKEVATLSCGHNVSVEELAQTRIYWQKDKKMVLTMMSGDMKIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2420 - protein, 208 aa, Artificial Sequence
  CD80 v416 ECD
VIHVTKEVKEVATLSCGHNVSVEELAQTRIYWQKDKKMVLTMMSGDMNIWPEYKNRTIFDITNNLSIVILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2421 - protein, 208 aa, Artificial Sequence
  CD80 v417 ECD
VIHVTKEVKEVATLSCGHNVSVEELAQTRIYWQKEKKMVLTMMSGDVKIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2422 - protein, 208 aa, Artificial Sequence
  CD80 v418 ECD
VIHVTKEVKEVATLSCGHNVSVEELAQTRIYWQKEKKMVLTMMSGDVNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2423 - protein, 208 aa, Artificial Sequence
  CD80 v419 ECD
VIHVTKEVKEVATLSCGHNVSVEELAQTRIYWQKEKKMVLTMMSGDVNIWPEYKNRTIFDITNNLSIVILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2424 - protein, 208 aa, Artificial Sequence
  CD80 v420 ECD
VIHVTKEVKEVATLSCGHNVSVEELAQTRIYWQKEKKMVLTMMSGDMKIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2425 - protein, 208 aa, Artificial Sequence
  CD80 v421 ECD
VIHVTKEVKEVATLSCGHNVSVEELAQTRIYWQKEKKMVLTMMSGDMKIWPEYKNRTIFDITNNLSIVILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2426 - protein, 208 aa, Artificial Sequence
  CD80 v422 ECD
VIHVTKEVKEVATLSCGHNVSVEELAQTRIYWQKEKKMVLTMMSGDMNIWPEYKNRTIFDITNNLSIMILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2427 - protein, 208 aa, Artificial Sequence
  CD80 v423 ECD
VIHVTKEVKEVATLSCGHNVSVEELAQTRIYWQKDKKMVLTMMSGDVKIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2428 - protein, 208 aa, Artificial Sequence
  CD80 v424 ECD
VIHVTKEVKEVATLSCGHNVSVEELAQTRIYWQKDKKMVLTMMSGDVNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2429 - protein, 208 aa, Artificial Sequence
  CD80 v425 ECD
VIHVTKEVKEVATLSCGHNVSVEELAQTRIYWQKDKKMVLTMMSGDVNIWPEYKNRTIFDITNNLSIVILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2430 - protein, 208 aa, Artificial Sequence
  CD80 v426 ECD
VIHVTKEVKEVATLSCGHNVSVEELAQTRIYWQKDKKMVLTMMSGDMKIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2431 - protein, 208 aa, Artificial Sequence
  CD80 v427 ECD
VIHVTKEVKEVATLSCGHNVSVEELAQTRIYWQKDKKMVLTMMSGDMKIWPEYKNRTIFDITNNLSIVILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2432 - protein, 208 aa, Artificial Sequence
  CD80 v428 ECD
VIHVTKEVKEVATLSCGHNVSVEELAQTRIYWQKDKKMVLTMMSGDMNIWPEYKNRTIFDITNNLSIMILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2433 - protein, 208 aa, Artificial Sequence
  CD80 v429 ECD
VIHVTKEVKEVATLSCGHNVSVEELAQTRIYWQKEKKMVLTMMSGDVKIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2434 - protein, 208 aa, Artificial Sequence
  CD80 v430 ECD
VIHVTKEVKEVATLSCGHNVSVEELAQTRIYWQKEKKMVLTMMSGDVKIWPEYKNRTIFDITNNLSIVILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2435 - protein, 208 aa, Artificial Sequence
  CD80 v431 ECD
VIHVTKEVKEVATLSCGHNVSVEELAQTRIYWQKEKKMVLTMMSGDVNIWPEYKNRTIFDITNNLSIMILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2436 - protein, 208 aa, Artificial Sequence
  CD80 v432 ECD
VIHVTKEVKEVATLSCGHNVSVEELAQTRIYWQKEKKMVLTMMSGDMKIWPEYKNRTIFDITNNLSIMILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2437 - protein, 208 aa, Artificial Sequence
  CD80 v433 ECD
VIHVTKEVKEVATLSCGHNVSVEELAQTRIYWQKDKKMVLTMMSGDVKIWPEYKNRTIFDITNNLSIVILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2438 - protein, 208 aa, Artificial Sequence
  CD80 v434 ECD
VIHVTKEVKEVATLSCGHNVSVEELAQTRIYWQKDKKMVLTMMSGDVNIWPEYKNRTIFDITNNLSIMILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2439 - protein, 208 aa, Artificial Sequence
  CD80 v435 ECD
VIHVTKEVKEVATLSCGHNVSVEELAQTRIYWQKDKKMVLTMMSGDMKIWPEYKNRTIFDITNNLSIMILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2440 - protein, 208 aa, Artificial Sequence
  CD80 v436 ECD
VIHVTKEVKEVATLSCGHNVSVEELAQTRIYWQKEKKMVLTMMSGDVKIWPEYKNRTIFDITNNLSIMILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2441 - protein, 208 aa, Artificial Sequence
  CD80 v437 ECD
VIHVTKEVKEVATLSCGHNVSVEELAQTRIYWQKDKKMVLTMMSGVVKIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2442 - protein, 208 aa, Artificial Sequence
  CD80 v438 ECD
VIHVTKEVKEVATLSCGHNVSVEELAQTRIYWQKDKKMVLTMMSGVVNIWPEYKNRTIFDITNNLSIMILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2443 - protein, 208 aa, Artificial Sequence
  CD80 v439 ECD
VIHVTKEVKEVATLSCGHNVSVEELAQTRIYWQKDKKMVLTMMSGVVNIWPEYKNRTIFDITNNLSIMILALRPSDEGTYECVVLKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2444 - protein, 208 aa, Artificial Sequence
  CD80 v440 ECD
VIHVTKEVKEVATLSCGHNVSVEELAQTRIYWQKDKKMVLTMMSGDVKIWPEYKNRTIFDITNNLSIMILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2445 - protein, 208 aa, Artificial Sequence
  CD80 v441 ECD
VIHVTKEVKEVATLSCGHNVSVEELAQTRIYWQKDKKMVLTMMSGDVNIWPEYKNRTIFDITNNLSIMILALRPSDEGTYECVVQKYENDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2446 - protein, 208 aa, Artificial Sequence
  CD80 v442 ECD
VIHVTKEVKEVATLSCGHNVSVEELEQTRIYWQKDKKMVLTMMSGDLNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2447 - protein, 208 aa, Artificial Sequence
  CD80 v443 ECD
VIHVTKEVKEVATLSCGYNVSVEELAQTRIYWQKDKKMVLTMMSGDLNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2448 - protein, 208 aa, Artificial Sequence
  CD80 v444 ECD
VIHVTKEVKEVATLSCGYNVSVEELEQTRIYWQKEKKMVLTMMSGDLNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2449 - protein, 208 aa, Artificial Sequence
  CD80 v445 ECD
VIHVTKEVKEVATLSCGYNVSVEELEQTRIYWQKDKKMVLTMMSGDMNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2450 - protein, 208 aa, Artificial Sequence
  CD80 v446 ECD
VIHVTKEVKEVATLSCGYNVSVEELEQTRIYWQKDKKMVLTMMSGDLNIWPEYKNRTIFDITNNLSIVILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2451 - protein, 208 aa, Artificial Sequence
  CD80 v447 ECD
VIHVTKEVKEVATLSCGYNVSVEELEQTRIYWQKDKKMVLTMMSGDLNIWPEYKNRTIFDITNNLSIMILALRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2452 - protein, 208 aa, Artificial Sequence
  CD80 v448 ECD
VIHVTKEVKEVATLSCGYNVSVEELEQTRIYWQKDKKMVLTMMSGDLNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2453 - protein, 208 aa, Artificial Sequence
  CD80 v449 ECD
VIHVTKEVKEVATLSCGHNVSVEELAQTRIYWQKDKKMVLTMMSGDLNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2454 - protein, 208 aa, Artificial Sequence
  CD80 v450 ECD
VIHVTKEVKEVATLSCGYNVSVEELAQTRIYWQKEKKMVLTMMSGDLNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2455 - protein, 208 aa, Artificial Sequence
  CD80 v451 ECD
VIHVTKEVKEVATLSCGYNVSVEELEQTRIYWQKEKKMVLTMMSGDMNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2456 - protein, 208 aa, Artificial Sequence
  CD80 v452 ECD
VIHVTKEVKEVATLSCGYNVSVEELEQTRIYWQKDKKMVLTMMSGDMNIWPEYKNRTIFDITNNLSIVILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2457 - protein, 208 aa, Artificial Sequence
  CD80 v453 ECD
VIHVTKEVKEVATLSCGYNVSVEELEQTRIYWQKDKKMVLTMMSGDLNIWPEYKNRTIFDITNNLSIVILALRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2458 - protein, 208 aa, Artificial Sequence
  CD80 v454 ECD
VIHVTKEVKEVATLSCGYNVSVEELEQTRIYWQKDKKMVLTMMSGDLNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2459 - protein, 208 aa, Artificial Sequence
  CD80 v455 ECD
VIHVTKEVKEVATLSCGHNVSVEELEQTRIYWQKEKKMVLTMMSGDLNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2460 - protein, 208 aa, Artificial Sequence
  CD80 v456 ECD
VIHVTKEVKEVATLSCGHNVSVEELEQTRIYWQKDKKMVLTMMSGDMNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2461 - protein, 208 aa, Artificial Sequence
  CD80 v457 ECD
VIHVTKEVKEVATLSCGHNVSVEELEQTRIYWQKDKKMVLTMMSGDLNIWPEYKNRTIFDITNNLSIVILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2462 - protein, 208 aa, Artificial Sequence
  CD80 v458 ECD
VIHVTKEVKEVATLSCGHNVSVEELEQTRIYWQKDKKMVLTMMSGDLNIWPEYKNRTIFDITNNLSIMILALRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2463 - protein, 208 aa, Artificial Sequence
  CD80 v459 ECD
VIHVTKEVKEVATLSCGHNVSVEELEQTRIYWQKDKKMVLTMMSGDLNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2464 - protein, 208 aa, Artificial Sequence
  CD80 v460 ECD
VIHVTKEVKEVATLSCGYNVSVEELAQTRIYWQKDKKMVLTMMSGDMNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2465 - protein, 208 aa, Artificial Sequence
  CD80 v461 ECD
VIHVTKEVKEVATLSCGYNVSVEELAQTRIYWQKDKKMVLTMMSGDLNIWPEYKNRTIFDITNNLSIVILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2466 - protein, 208 aa, Artificial Sequence
  CD80 v462 ECD
VIHVTKEVKEVATLSCGYNVSVEELAQTRIYWQKDKKMVLTMMSGDLNIWPEYKNRTIFDITNNLSIMILALRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2467 - protein, 208 aa, Artificial Sequence
  CD80 v463 ECD
VIHVTKEVKEVATLSCGYNVSVEELAQTRIYWQKDKKMVLTMMSGDLNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2468 - protein, 208 aa, Artificial Sequence
  CD80 v464 ECD
VIHVTKEVKEVATLSCGYNVSVEELEQTRIYWQKEKKMVLTMMSGDLNIWPEYKNRTIFDITNNLSIVILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2469 - protein, 208 aa, Artificial Sequence
  CD80 v465 ECD
VIHVTKEVKEVATLSCGYNVSVEELEQTRIYWQKEKKMVLTMMSGDLNIWPEYKNRTIFDITNNLSIMILALRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2470 - protein, 208 aa, Artificial Sequence
  CD80 v466 ECD
VIHVTKEVKEVATLSCGYNVSVEELEQTRIYWQKEKKMVLTMMSGDLNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2471 - protein, 208 aa, Artificial Sequence
  CD80 v467 ECD
VIHVTKEVKEVATLSCGYNVSVEELEQTRIYWQKDKKMVLTMMSGDMNIWPEYKNRTIFDITNNLSIMILALRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2472 - protein, 208 aa, Artificial Sequence
  CD80 v468 ECD
VIHVTKEVKEVATLSCGYNVSVEELEQTRIYWQKDKKMVLTMMSGDMNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2473 - protein, 208 aa, Artificial Sequence
  CD80 v469 ECD
VIHVTKEVKEVATLSCGYNVSVEELEQTRIYWQKDKKMVLTMMSGDLNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2474 - protein, 208 aa, Artificial Sequence
  CD80 v470 ECD
VIHVTKEVKEVATLSCGHNVSVEELAQTRIYWQKEKKMVLTMMSGDLNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2475 - protein, 208 aa, Artificial Sequence
  CD80 v471 ECD
VIHVTKEVKEVATLSCGYNVSVEELAQTRIYWQKEKKMVLTMMSGDMNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2476 - protein, 208 aa, Artificial Sequence
  CD80 v472 ECD
VIHVTKEVKEVATLSCGYNVSVEELEQTRIYWQKEKKMVLTMMSGDMNIWPEYKNRTIFDITNNLSIVILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2477 - protein, 208 aa, Artificial Sequence
  CD80 v473 ECD
VIHVTKEVKEVATLSCGYNVSVEELEQTRIYWQKDKKMVLTMMSGDMNIWPEYKNRTIFDITNNLSIVILALRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2478 - protein, 208 aa, Artificial Sequence
  CD80 v474 ECD
VIHVTKEVKEVATLSCGYNVSVEELEQTRIYWQKDKKMVLTMMSGDLNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2479 - protein, 208 aa, Artificial Sequence
  CD80 v475 ECD
VIHVTKEVKEVATLSCGHNVSVEELAQTRIYWQKDKKMVLTMMSGDMNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2480 - protein, 208 aa, Artificial Sequence
  CD80 v476 ECD
VIHVTKEVKEVATLSCGHNVSVEELAQTRIYWQKDKKMVLTMMSGDLNIWPEYKNRTIFDITNNLSIVILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2481 - protein, 208 aa, Artificial Sequence
  CD80 v477 ECD
VIHVTKEVKEVATLSCGHNVSVEELAQTRIYWQKDKKMVLTMMSGDLNIWPEYKNRTIFDITNNLSIMILALRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2482 - protein, 208 aa, Artificial Sequence
  CD80 v478 ECD
VIHVTKEVKEVATLSCGHNVSVEELAQTRIYWQKDKKMVLTMMSGDLNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2483 - protein, 208 aa, Artificial Sequence
  CD80 v479 ECD
VIHVTKEVKEVATLSCGHNVSVEELEQTRIYWQKEKKMVLTMMSGDMNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2484 - protein, 208 aa, Artificial Sequence
  CD80 v480 ECD
VIHVTKEVKEVATLSCGHNVSVEELEQTRIYWQKEKKMVLTMMSGDLNIWPEYKNRTIFDITNNLSIVILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2485 - protein, 208 aa, Artificial Sequence
  CD80 v481 ECD
VIHVTKEVKEVATLSCGHNVSVEELEQTRIYWQKEKKMVLTMMSGDLNIWPEYKNRTIFDITNNLSIMILALRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2486 - protein, 208 aa, Artificial Sequence
  CD80 v482 ECD
VIHVTKEVKEVATLSCGHNVSVEELEQTRIYWQKEKKMVLTMMSGDLNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2487 - protein, 208 aa, Artificial Sequence
  CD80 v483 ECD
VIHVTKEVKEVATLSCGHNVSVEELEQTRIYWQKDKKMVLTMMSGDMNIWPEYKNRTIFDITNNLSIVILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2488 - protein, 208 aa, Artificial Sequence
  CD80 v484 ECD
VIHVTKEVKEVATLSCGHNVSVEELEQTRIYWQKDKKMVLTMMSGDMNIWPEYKNRTIFDITNNLSIMILALRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2489 - protein, 208 aa, Artificial Sequence
  CD80 v485 ECD
VIHVTKEVKEVATLSCGHNVSVEELEQTRIYWQKDKKMVLTMMSGDMNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2490 - protein, 208 aa, Artificial Sequence
  CD80 v486 ECD
VIHVTKEVKEVATLSCGHNVSVEELEQTRIYWQKDKKMVLTMMSGDLNIWPEYKNRTIFDITNNLSIVILALRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2491 - protein, 208 aa, Artificial Sequence
  CD80 v487 ECD
VIHVTKEVKEVATLSCGHNVSVEELEQTRIYWQKDKKMVLTMMSGDLNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2492 - protein, 208 aa, Artificial Sequence
  CD80 v488 ECD
VIHVTKEVKEVATLSCGYNVSVEELAQTRIYWQKEKKMVLTMMSGDLNIWPEYKNRTIFDITNNLSIVILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2493 - protein, 208 aa, Artificial Sequence
  CD80 v489 ECD
VIHVTKEVKEVATLSCGYNVSVEELAQTRIYWQKEKKMVLTMMSGDLNIWPEYKNRTIFDITNNLSIMILALRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2494 - protein, 208 aa, Artificial Sequence
  CD80 v490 ECD
VIHVTKEVKEVATLSCGYNVSVEELAQTRIYWQKEKKMVLTMMSGDLNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2495 - protein, 208 aa, Artificial Sequence
  CD80 v491 ECD
VIHVTKEVKEVATLSCGYNVSVEELAQTRIYWQKDKKMVLTMMSGDMNIWPEYKNRTIFDITNNLSIVILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2496 - protein, 208 aa, Artificial Sequence
  CD80 v492 ECD
VIHVTKEVKEVATLSCGYNVSVEELAQTRIYWQKDKKMVLTMMSGDMNIWPEYKNRTIFDITNNLSIMILALRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2497 - protein, 208 aa, Artificial Sequence
  CD80 v493 ECD
VIHVTKEVKEVATLSCGYNVSVEELAQTRIYWQKDKKMVLTMMSGDMNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2498 - protein, 208 aa, Artificial Sequence
  CD80 v494 ECD
VIHVTKEVKEVATLSCGYNVSVEELAQTRIYWQKDKKMVLTMMSGDLNIWPEYKNRTIFDITNNLSIVILALRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2499 - protein, 208 aa, Artificial Sequence
  CD80 v495 ECD
VIHVTKEVKEVATLSCGYNVSVEELAQTRIYWQKDKKMVLTMMSGDLNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2500 - protein, 208 aa, Artificial Sequence
  CD80 v496 ECD
VIHVTKEVKEVATLSCGYNVSVEELAQTRIYWQKDKKMVLTMMSGDLNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2501 - protein, 208 aa, Artificial Sequence
  CD80 v497 ECD
VIHVTKEVKEVATLSCGYNVSVEELEQTRIYWQKEKKMVLTMMSGDMNIWPEYKNRTIFDITNNLSIMILALRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2502 - protein, 208 aa, Artificial Sequence
  CD80 v498 ECD
VIHVTKEVKEVATLSCGYNVSVEELEQTRIYWQKEKKMVLTMMSGDMNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2503 - protein, 208 aa, Artificial Sequence
  CD80 v499 ECD
VIHVTKEVKEVATLSCGYNVSVEELEQTRIYWQKEKKMVLTMMSGDLNIWPEYKNRTIFDITNNLSIVILALRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2504 - protein, 208 aa, Artificial Sequence
  CD80 v500 ECD
VIHVTKEVKEVATLSCGYNVSVEELEQTRIYWQKEKKMVLTMMSGDLNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2505 - protein, 208 aa, Artificial Sequence
  CD80 v501 ECD
VIHVTKEVKEVATLSCGYNVSVEELEQTRIYWQKEKKMVLTMMSGDLNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2506 - protein, 208 aa, Artificial Sequence
  CD80 v502 ECD
VIHVTKEVKEVATLSCGYNVSVEELEQTRIYWQKDKKMVLTMMSGDMNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2507 - protein, 208 aa, Artificial Sequence
  CD80 v503 ECD
VIHVTKEVKEVATLSCGYNVSVEELEQTRIYWQKDKKMVLTMMSGDMNIWPEYKNRTIFDITNNLSIMILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2508 - protein, 101 aa, Artificial Sequence
  CD80 v292 IgV
VIHVTKEVKEVATLSCGHNVSVEELAQTRIYWQKDKKMVLTMMSGDMKIWPEYKNRTIFDITNNLSIVILAVRPSDEGTYECVVLKYEKDAFKREHLAEVT

SEQ ID NO: 2509 - protein, 101 aa, Artificial Sequence
  CD80 v293 IgV
VIHVTKEVKEVATLSCGHNVSVEELAQTRIYWQKDKKMVLSMMSGDMTIWPEYKNRTIFDITNNLSIVILALRPSDEGTYECVVLKYEKDAFKREHLAEVT

SEQ ID NO: 2510 - protein, 101 aa, Artificial Sequence
  CD80 v294 IgV
VIHVTKEVKEVATLSCGHNVSVEELAQTRIYWQKEKKMVLTMMSGVINIWPEYKNRTIFDITNNLSIVILGLRPSDEGTYECVVLKYEKDAFKREHLAEVT

SEQ ID NO: 2511 - protein, 101 aa, Artificial Sequence
  CD80 v295 IgV
VIHVTKEVKEVATLSCGHNVSVEELAQTRIYWQKEKKMVLTMMSGDINIWPEYKNRTIFDITNNLSIVILGLRPSDEGTYECVVLKYEKDAFKREHLAEVT

SEQ ID NO: 2512 - protein, 101 aa, Artificial Sequence
  CD80 v296 IgV
VIHVTKEVKEVATLSCGHNVSVEELAQTRIYWQKDKKMVLTMISGDLNIWPEYKNRTIFDITNNLSIVILALRPSDEGTYECVVMKYEKDAFKREHLAEVT

SEQ ID NO: 2513 - protein, 101 aa, Artificial Sequence
  CD80 v297 IgV
VIHVTKEVKEVATLSCGHNVSVEELAQTRIYWQKDKKMVLTMISGEMNIWPEYKNRTIFDITNNLSIVILGLRPSDEGTYECVVMKYEKDAFKREHLAEVT

SEQ ID NO: 2514 - protein, 101 aa, Artificial Sequence
  CD80 v298 IgV
VIHVTKEVKEVATLSCGYNVSVEELAQTRIYWQKDKKMVLTMMSGDLNIWPEYKNRTIFDITNNLSIVILGLRPSDEGTYECVVLKYEKDSFKREHLAEVT

SEQ ID NO: 2515 - protein, 101 aa, Artificial Sequence
  CD80 v299 IgV
VIHVTKEVKEVATLSCGHNVSVEELAQTRIYWQKDKKMVLTMMSGDIKIWPEYKNRTIFDFTNNLSIVILALRPSDEGTYECVVLKYEKDAFKREHLAEVT

SEQ ID NO: 2516 - protein, 101 aa, Artificial Sequence
  CD80 v300 IgV
VIHVTKEVKEVATLSCGHNVSVEELAQTRIYWQKDKKMVLTMMSGDVNIWPEYKNRTIFDISNNLSIVILALRPSDEGTYECVVQKYEKDAFKREHLAEVT

SEQ ID NO: 2517 - protein, 101 aa, Artificial Sequence
  CD80 v301 IgV
VIHVTKEVKEVATLSCGHNVSVEELAQTRIYWQKEKKMVLTMISGDLNIWPEYKNRTIFDITNNLSIVILGLRPSDEGTYECVVLKYEKDAFKREHLAEVT

SEQ ID NO: 2518 - protein, 101 aa, Artificial Sequence
  CD80 v302 IgV
VIHVTKEVKEVATLSCGHNVSVEELAQTRIYWQKDKKMVLTMMSGDVNIWPEYKNRTIFDITNNLSIVILALRPSDEGTYECVVLKYEKDAFKREHLAEVT

SEQ ID NO: 2519 - protein, 101 aa, Artificial Sequence
  CD80 v303 IgV
VIHVTKEVKEVATLSCGHNVSVEELAQTRIYWQKDKKMVLTMMSGDLNIWPEYKNRTIFDITNNLSIVILGLRPSDEGTYECVVMKYEKDAFKREHLAEVT

SEQ ID NO: 2520 - protein, 101 aa, Artificial Sequence
  CD80 v304 IgV
VIHVTKEVKEVATLSCGHNVSAEELAQTRIYWQKDKKMVLTMMSGDLNIWPEYKNRTIFDITNNLSIVILGLRPSDEGTYECVVLKYEKDAFKREHLAEVT

SEQ ID NO: 2521 - protein, 101 aa, Artificial Sequence
  CD80 v305 IgV
VIHVTKEVKEVATLSCGHNVSVEELAQTRIYWQKDKKMVLTMMSGDLNIWPEYKNRTIFDITNNLSIVILGLRPSDEGTYECVVLKYEKDAFKREHLAEVT

SEQ ID NO: 2522 - protein, 101 aa, Artificial Sequence
  CD80 v306 IgV
VIHVTKEVKEVATLSCGHNVSVEELAQTRIYWQKDKKMVLTMMSGEINIWPEYKNRTIFDITNNLSIVILALRPSDEGTYECVVLKYEKDAFKREHLAEVT

SEQ ID NO: 2523 - protein, 101 aa, Artificial Sequence
  CD80 v307 IgV
VIHVTKEVKEVATLSCGHNVSVEELAHTRIYWQKDKKMVLTMMSGDINIWPEYKNRTIFDITNNLSIVILALRPSDEGTYECVVLKYEKDAFKREHLAEVT

SEQ ID NO: 2524 - protein, 101 aa, Artificial Sequence
  CD80 v308 IgV
VIHVTKEVKEVATLSCGHNVSVEELAQTRIYWQKDKKMVLTMMSGEMNIWPEYKNRTIFDITNNLSIVILALRPSDEGTYECVVMKYEKDAFKREHLAEVT

SEQ ID NO: 2525 - protein, 101 aa, Artificial Sequence
  CD80 v309 IgV
VIHVTKEVKEVATLSCGHNVSVEELAQTRIYWQKDKKMVLTMMSGEMNIWPEYKNRTIFDITNNLSIVILALRPSDEGTYECVVLKYEKDGFKREHLAEVT

SEQ ID NO: 2526 - protein, 101 aa, Artificial Sequence
  CD80 v310 IgV
VIHVTKEVKEVATLSCGHNVSVEELAQTRIYWQKDKKMVLTMMSGEMNIWPEYKNRTIFDITNNLSIVILALRPSDEGTYECVVLKYEKDAFKREHLAEVT

SEQ ID NO: 2527 - protein, 101 aa, Artificial Sequence
  CD80 v311 IgV
VIHVTKEVKEVATLSCGHNVSVEELAQTRIYWQKDKKMVLTMMSGDMNIWPEYKNRTIFDITNNLSIVILALRPSDEGTYECVVLKYEKDAFKREHRAEVT

SEQ ID NO: 2528 - protein, 101 aa, Artificial Sequence
  CD80 v312 IgV
VIHVTKEVKEVATLSCGYNVSVEELAQTRIYWQKDKKMVLTMMSGDMNIWPEYKNRTIFDITNNLSIVILALRPSDEGTYECVVLKYEKDAFKREHLAEVT

SEQ ID NO: 2529 - protein, 101 aa, Artificial Sequence
  CD80 v313 IgV
VIHVTKEVKEVATLSCGHNVSVEELALTRIYWQKDKKMVLTMMSGDVNIWPEYKNRTIFDVTNNLSIVILALRPSDEGTYECVVMKYEKDAFKREHLAEVT

SEQ ID NO: 2530 - protein, 101 aa, Artificial Sequence
  CD80 v314 IgV
VIHVTKEVKEVATLSCGHNVSVEELAQTRIYWQKDKKMVLTMMSGDVNIWPEYKNRTIFDVTNNLSIVILALRPSDEGTYECVVMKYEKDAFKREHLAEVT

SEQ ID NO: 2531 - protein, 101 aa, Artificial Sequence
  CD80 v315 IgV
VIHVTKEVKEVATLSCGHNVSVEELAQTRIYWQKDKKMVLTMMSGDVNIWPEYKNRTIFDITNNLSIVILALRPSDEGTYECVVMKYEKDAFKQEHLAEVT

SEQ ID NO: 2532 - protein, 101 aa, Artificial Sequence
  CD80 v316 IgV
VIHVTKEVKEVATLSCGHNVSVEELAQTRIYWQKDKKMVLTMMSGDVKIWPEYKNRTIFDITNNLSIVILALRPSDEGTYECVVMKYEKDAFKREHLAEVT

SEQ ID NO: 2533 - protein, 101 aa, Artificial Sequence
  CD80 v317 IgV
VIHVTKEVKEVATLSCGYNVSVEELAQTRIYWQKDKKMVLTMMSGDVKIWPEYKNRTIFDITNNLSIVILALRPSDEGTYECVVLKYEKDAFKREHLAEVT

SEQ ID NO: 2534 - protein, 101 aa, Artificial Sequence
  CD80 v318 IgV
VIHVTKEVKEVATLSCGHNVSVEELERTRIYWQKDKKMVLTMMSGDLYIWPEYKNRTIFDITNNLSIVILALRPSDEGTYECVVQKYEKDAFKREHLAEVT

SEQ ID NO: 2535 - protein, 101 aa, Artificial Sequence
  CD80 v319 IgV
VIHVTKEVKEVATLSCGHNVSVEELAQTRIYWQKDKKMVLTMMSGELNIWPEYKNRTIFDITNNLSIMILALRPSDEGTYECVVQKYEKDALKREHLAEVT

SEQ ID NO: 2536 - protein, 101 aa, Artificial Sequence
  CD80 v320 IgV
VIHVTKEVKEVATLSCGHNVSVEELAQTRIYWQKDKKMVLTMMSGDINIWPEYKNRTIFDISNNLSIVILALRPSDEGTYECVVQKYDKDAFKREHLAEVT

SEQ ID NO: 2537 - protein, 101 aa, Artificial Sequence
  CD80 v321 IgV
VIHVTKEVKEVATLSCGHNVSVEDLARTRIYWQKDKKMVLSMMSGDVNIWPEYKNRTIFDITNNLSIVILALRPSDEGTYECVVQKYEKDAFKREHLAEVT

SEQ ID NO: 2538 - protein, 101 aa, Artificial Sequence
  CD80 v322 IgV
VIHVTKEVKEVATLTCGYNVSVEELAQTRIYWQKDKKMVLTMMSGDVNIWPEYKNRTIFDIANSLSIVILGLRPSDEGTYECVVQKYEKNAFKREHLAEVT

SEQ ID NO: 2539 - protein, 101 aa, Artificial Sequence
  CD80 v323 IgV
VIHVTKEVKEVATLSCGHNVSVEELAQTRIYWQKDKKMVLTMMSGDLNIWPEYKNRTIFDITNNLSIMILGLRPSDEGTYECVVQKYEKGAFKREHLAEVT

SEQ ID NO: 2540 - protein, 101 aa, Artificial Sequence
  CD80 v324 IgV
VIHVTKEVKEVATLSCGYNVSVEELAQTRIYWQKDKKMVLTMMSGDINIWPEYKNRTIFDITNNLSIMILGLRPSDEGTYECVVLKYEKDAFKLEHLAEVT

SEQ ID NO: 2541 - protein, 12 aa, Artificial Sequence
  CD80 v325 IgV
VIHVTKEVKEVT

SEQ ID NO: 2542 - protein, 101 aa, Artificial Sequence
  CD80 v326 IgV
VIHVTKEVKEVATLSCGHNVSVEELAQTRIYWRKEKKMVLTMMSGDVNIWPEYKNRTIFDINNNLSIVILGLRPSDEGTYECVVLKYEKDAFKREHLAEVT

SEQ ID NO: 2543 - protein, 101 aa, Artificial Sequence
  CD80 v327 IgV
VIHVTKEVKEVATLSCGYNVSAEELAQTRIYWQKDKKMVLSMMSGDVNIWPEYKNRTIFDINNNLSIVILGLRPSDEGTYECVVLKYEKDGFKREHLAEVT

SEQ ID NO: 2544 - protein, 101 aa, Artificial Sequence
  CD80 v328 IgV
VIHVTKEVKEVATLSCGHNVSVEELAQTRIYWQKDKKMVLTMMSGDLNIWPEYKNRTIFDITNNLSIVIMALRPSDEGTYECVVLKYEKDAFKREHLAEVT

SEQ ID NO: 2545 - protein, 101 aa, Artificial Sequence
  CD80 v329 IgV
VIHVTKEVKEVATLSCGHNVSVEELAQTRIYWQKDKKMVLTMMSGDLNIWPEYKNRTIFDITNNLSIMILALRPSDEGTYECVVLKYEKDAFKREHLAEVT

SEQ ID NO: 2546 - protein, 101 aa, Artificial Sequence
  CD80 v330 IgV
VIHVTKEVKEVATLSCGHNVSVEELAQTRIYWQKDKKMVLTMMSGVLNIWPEYKNRTIFDITNNLSIMILALRPSDEGTYECVVLKYDKDAFKREHLAEVT

SEQ ID NO: 2547 - protein, 101 aa, Artificial Sequence
  CD80 v331 IgV
VIHVTKEVKEVATLSCGHNVSVEELAQTRIYWQKDKKMVLTMMSGVLNIWPEYKNRTIFDITNNLSIMILALRPSDEGTYECVVLKYEKGAFKREHLAEVT

SEQ ID NO: 2548 - protein, 101 aa, Artificial Sequence
  CD80 v332 IgV
VIHVTKEVKEVATLSCGHNVSVEELAQTRIYWQKDKKMVLTMMSGVLNIWPEYKNRTIFDITNNLSIMILALRPSDEGTYECVVLKYENDAFKREHLAEVT

SEQ ID NO: 2549 - protein, 101 aa, Artificial Sequence
  CD80 v333 IgV
VIHVTKEVKEVATLSCGHNVSVEELAQTRIYWQKDKKMVLTMMSGVLNIWPEYKNRTIFDITNNLSIMILALRPSDEGTYECVVQKYEKDAFKREHLAEVT

SEQ ID NO: 2550 - protein, 101 aa, Artificial Sequence
  CD80 v334 IgV
VIHVTKEVKEVATLSCGHNVSVEELAQTRIYWQKDKKMVLTMMSGVLNIWPEYKNRTIFDITNNLSIMILALRPSDEGTYECVVLKYEKDAFKREHLAEVT

SEQ ID NO: 2551 - protein, 101 aa, Artificial Sequence
  CD80 v335 IgV
VIHVTKEVKEVATLSCGHNVSVEELAQTRIYWQKDKKMVLTMMSGVLNIWPEYKNRTIFDITNNLSIVIMALRPSDEGTYECVVLKYEKDAFKREHLAEVT

SEQ ID NO: 2552 - protein, 101 aa, Artificial Sequence
  CD80 v336 IgV
VIHVTKEVKEVATLSCGHNVSVEELAQTRIYWQKDKKMVLTMMSGVLNIWPEYKNRTIFDITNNLSIVIMALRPSDEGTYECVVQKYEKDAFKREHLAEVT

SEQ ID NO: 2553 - protein, 101 aa, Artificial Sequence
  CD80 v337 IgV
VIHVTKEVKEVATLSCGHNVSVEELAQTRIYWQKDKKMVLTMMSGDVKIWPEYKNRTIFDITNNLSIMILALRPSDEGTYECVVLKYEKDAFKREHLAEVT

SEQ ID NO: 2554 - protein, 101 aa, Artificial Sequence
  CD80 v338 IgV
VIHVTKEVKEVATLSCGHNVSVEDLAQTRIYWQKDKKMVLTMMSGDLNIWPEYKNRTIFDITNNLSIMILALRPSDEGTYECVVLKYEKDAFKRVHQAEVT

SEQ ID NO: 2555 - protein, 101 aa, Artificial Sequence
  CD80 v339 IgV
VIHVTKEVKEVATLSCGHNVSVEELAQTRIYWQKDKKMVLTMMSGEINIWPEYKNRTIFDIANNLSIMILALRPSDEGTYECVVMKCEKDAFKREHLAEVT

SEQ ID NO: 2556 - protein, 101 aa, Artificial Sequence
  CD80 v340 IgV
VIHVTKEVKEVATLSCGHNVSVEELAQTRIYWQKDKKMVLTMMSGEINIWPEYKNRTIFDITNNLSIMILALRPSDEGTYECVVMKYEKDAFKREHLAEVT

SEQ ID NO: 2557 - protein, 101 aa, Artificial Sequence
  CD80 v341 IgV
VIHVTKEVKEVATLSCGHNVSVEELAQTRIYWQKDKKMVLTMMSGELNIWPEYKNRTIFDITNNLSIMILGLRPSDEGTYECVVLKCEKDAFRREHLAEVT

SEQ ID NO: 2558 - protein, 101 aa, Artificial Sequence
  CD80 v342 IgV
VIHVTKEVKEVATLSCGHNVSVEELAQTRIYWQKDKKMVLTMMSGELNIWPEYKNRTIFDITNNLSIMILALRPSDEGMYECVVMKYEKDAFKREHLAEVT

SEQ ID NO: 2559 - protein, 101 aa, Artificial Sequence
  CD80 v343 IgV
VIHVTKEVKEVATLSCGHNVSVEELAQTRIYWQKDKKMVLTMMSGELNIWPEYKNRTIFDITNNLSIMILALRPSDEGMYECVVMKYEKDAFKREHQAEVT

SEQ ID NO: 2560 - protein, 101 aa, Artificial Sequence
  CD80 v344 IgV
VIHVTKEVKEVATLSCGHNVSVEELAQTRIYWQKDKKMVLTMMSGEVNIWPEYKNRTIFDITNNLSIMILALRPSDEGTYECVVQKYEKDAFKREHLAEVT

SEQ ID NO: 2561 - protein, 101 aa, Artificial Sequence
  CD80 v345 IgV
VIHVTKEVKEVATLSCGHNVSVEELAQTRIYWQKDKKMVLTMISGDLNIWPEYKNRTIFDITNNLSIMILALRPSDEGTYECVVLKYEKDAFKREHLAEVT

SEQ ID NO: 2562 - protein, 101 aa, Artificial Sequence
  CD80 v346 IgV
VIHVTKEVKEVATLSCGHNVSVEELAQTRIYWQKDKKMVLTMMSGDINIWPEYKNRTIFDITNNLSIMILALRPSDEGTYECVVLKNEKDAFKREHLAEVT

SEQ ID NO: 2563 - protein, 101 aa, Artificial Sequence
  CD80 v347 IgV
VIHVTKEVKEVATLSCGHNVSVEELAQTRIYWQKDKKMVLTMMSGDLNIWPEYKNRTIFDITNNLSIMILALRPSDEGTYECVVLKYEKDAFKRVHQAEVT

SEQ ID NO: 2564 - protein, 101 aa, Artificial Sequence
  CD80 v348 IgV
VIHVTKEVKEVATLSCGHNVSVEELAQTRIYWQKDKKMVLTMMSGDLNIWPEFKNRTIFDITNNLSIMILGLRPSDEGTYECVVLKYEKDAFRRVHLAEVT

SEQ ID NO: 2565 - protein, 101 aa, Artificial Sequence
  CD80 v349 IgV
VIHVTKEVKEVATLSCGHNVSVEELAQTRIYWQKDKKMVLTMMSGDVKIWPEYKNRTIFDITNNLSIMILGLRPSDEGTYECVVMKYEKDAFKREHLAEVT

SEQ ID NO: 2566 - protein, 101 aa, Artificial Sequence
  CD80 v350 IgV
VIHVTKEVKEVATLSCGHNVSVEELAQTRIYWQKDKKMVLTMMSGDVKIWPEYKNRTIFDITNNLSIMILALRPSDEGTYECVVMKYEKDAFKREHLAEVT

SEQ ID NO: 2567 - protein, 101 aa, Artificial Sequence
  CD80 v351 IgV
VIHVTKEVKEVATLSCGHNVSVEELAQTRIYWQKDKKMVLTMMSGDVNIWPEYKNRTIFDITNNLSIMILALRPSDEGTYECVVMKYEKDAFKREHLAEVT

SEQ ID NO: 2568 - protein, 101 aa, Artificial Sequence
  CD80 v352 IgV
VIHVTKEVKEVATLSCGHNVSVEELAQTRIYWQKDKKMVLTMMSGDVNIWPEYKNRTIFDITNNLSIMILALRPSDEGTYECVVMKDEKDAFKREHLAEVT

SEQ ID NO: 2569 - protein, 101 aa, Artificial Sequence
  CD80 v353 IgV
VIHVTKEVKEVATLSCGHNVSVEELAQTRIYWQKDKKMVLSMMSGEINIWPEYKNRTIFDITNNLSIMILALRPSDEGTYECVVLKYEKDAFRRVHLAEVT

SEQ ID NO: 2570 - protein, 101 aa, Artificial Sequence
  CD80 v354 IgV
VIHVTKEVKEVATLSCGYNVSVEELAQTRIYWQKDKKMVLTMMSGEINIWPEYKNRTIFDITNNLSIMILALRPSDEGTYECVVLKYEKDAFKLEHLAEVT

SEQ ID NO: 2571 - protein, 101 aa, Artificial Sequence
  CD80 v355 IgV
VIHVTKEVKEVATLSCGYNVSVEELAQTRIYWQKDKKIVLTMMSGDLNIWPEYKNRTIFDITNNLSIMILALRPSDEGTYECVVMKYEKDAFKREHLAEVT

SEQ ID NO: 2572 - protein, 101 aa, Artificial Sequence
  CD80 v356 IgV
VIHVTKEVKEVATLSCGYNVSVEELAQTRIYWQKDKKMVLTMMSGDINIWPEYKNRTIFDITNNLSIMILALRPSDEGTYECVVLKNEKDAFKREHLAEVT

SEQ ID NO: 2573 - protein, 101 aa, Artificial Sequence
  CD80 v357 IgV
VIHVTKEVKEVATLSCGYNVSVEELAQTRIYWQKDKKMVLTMMSGDLNIWPEYKNRTIFDITNNLSIMILGLRPSDEGTYECVVMKYEKDAFKREHLAEVT

SEQ ID NO: 2574 - protein, 101 aa, Artificial Sequence
  CD80 v358 IgV
VIHVTKEVKEVATLSCGYNVSVEELAQTRIYWQKDKKMVLTMMSGDLNIWPEYKNRTIFDITNNLSIMILALRPSDEGTYECVVLKYEKDAFKRVHQAEVT

SEQ ID NO: 2575 - protein, 101 aa, Artificial Sequence
  CD80 v359 IgV
VIHVTKEVKEVATLSCGYNVSVEELAQTRIYWQKDKKMVLTMMSGDLNIWPEFKNRTIFDITNNLSIMILGLRPSDEGTYECVVLKYEKDAFKREHLAEVT

SEQ ID NO: 2576 - protein, 101 aa, Artificial Sequence
  CD80 v360 IgV
VIHVTKEVKEVATLSCGYNVSVEELAQTRIYWQKDKKMVLTMMSGDLNIWPEFKNRTIFDITNNLSIMILGLRPSDEGTYECVVLKYEKDAFRRVHLAEVT

SEQ ID NO: 2577 - protein, 101 aa, Artificial Sequence
  CD80 v361 IgV
VIHVTKEVKEVATLSCGYNVSVEELAQTRIYWQKDKKMVLTMMSGDVNIWPEYKNRTIFDITNNLSIMILALRPSDEGTYECVVMKYEKDAFKREHLAEVT

SEQ ID NO: 2578 - protein, 101 aa, Artificial Sequence
  CD80 v362 IgV
VIHVTKEVKEVATLSCGYNVSVEELAQTRIYWQKDKKMVLTMMSGDMNIWPEYKNRTIFDITNNLSIMILGLRPSDEGTYECVVLKYEKDAFKQVHLAEVT

SEQ ID NO: 2579 - protein, 101 aa, Artificial Sequence
  CD80 v363 IgV
VIHVTKEVKEVATLSCGYNVSVEELAQTRIYWQKDKKMVLTMMSGDMNIWPEYKNRTIFDITNNLSIMILALRPSDEGTYECVVMKYEKDAFKQEHLAEVT

SEQ ID NO: 2580 - protein, 101 aa, Artificial Sequence
  CD80 v364 IgV
VIHVTKEVKEVATLSCGYNVSVEELAQTRIYWQKDKKMVLTMMSGDMNIWPEYKNRTIFDITNNLSIMILALRPSDEGMYECVVMKYEKDAFKREHLAEVT

SEQ ID NO: 2581 - protein, 101 aa, Artificial Sequence
  CD80 v365 IgV
VIHVTKEVKEVATLSCGYNVSDEELAQTRIYWQKDKKMVLTMMSGDVKIWPEYKNRTIFDITNNLSIMILALRPSDEGTYECVVLKYEKDAFKREHLAEVT

SEQ ID NO: 2582 - protein, 101 aa, Artificial Sequence
  CD80 v366 IgV
VIHVTKEVKEVATLSCGHNVSVEELALTRIYWLKDKKMVLSMMSGDVKIWPEYKNRTIFDITNNLSIMILALRPSDEGTYECVVMKYEKDAFKREHLAEVT

SEQ ID NO: 2583 - protein, 101 aa, Artificial Sequence
  CD80 v367 IgV
VIHVTKEVKEVATLSCGHNVSVEELAQTRIYWLKDKKMVLTMMSGDVNIWPEYKNRTIFDISNNLSIMILALRPSDEGTYECVVMKYEKDAFKREHLAEVT

SEQ ID NO: 2584 - protein, 101 aa, Artificial Sequence
  CD80 v368 IgV
VIHVTKEVKEVATLSCGHNVSVEELAQTRIYWRKDKKIVLTMMSGDLNIWPEYKNRTIFDITNNLSIMILALRPSDEGTYECVVLKYEKDAFKREHLAEVT

SEQ ID NO: 2585 - protein, 101 aa, Artificial Sequence
  CD80 v369 IgV
VIHVTKEVKEVATLSCGHNVSVEELAQTCIYWQKDKKMVLTMMSGDLNIWPEYKNRTIFDITNNLSIMILGLRPSDEGTYECVVMKYEKDAFKREHLAEVT

SEQ ID NO: 2586 - protein, 101 aa, Artificial Sequence
  CD80 v370 IgV
VIHVTKEVKEVATLSCGHNVPVEELAQTRIYWQKDKEMVLTMMSGEINIWPEYKNRTIFDITNNLSIMILALRPSDEGTYECVVLKYEKDAFKREHLAEVT

SEQ ID NO: 2587 - protein, 101 aa, Artificial Sequence
  CD80 v371 IgV
VIHVTKEVKEVATLSCGHNVPVEELAQTRIYWQKDKEMVLTMMSGEINIWPEYKNRTIFDITNNLSIMILALRPSDEGTYECVVLKYEKDAFKLEHLAEVT

SEQ ID NO: 2588 - protein, 101 aa, Artificial Sequence
  CD80 v372 IgV
VIHVTKEVKEVARLSCGHNVSVEELAQTRIYWQKDKKMVLTMMSGDLNIWPEYKNRTIFDITNNLSIMILALRPSDEGTYECVVLKYEKDAFKREHLAEVT

SEQ ID NO: 2589 - protein, 101 aa, Artificial Sequence
  CD80 v373 IgV
VIHVTKEVKEVARLSCGYNVSVEELAQTRIYWQKDKKMVLTMMSGDMNIWPEYKNRTIFDITNNLSIMILALRPSDEGTYECVVMKYEKDAFKQEHLAEVT

SEQ ID NO: 2590 - protein, 101 aa, Artificial Sequence
  CD80 v374 IgV
VIHVTKEVKEVARLSCGHNVSVEELALTRIYWLKDKKMVLSMMSGDVKIWPEYKNRTIFDITNNLSIMILALRPSDEGTYECVVMKYEKDAFKREHLAEVT

SEQ ID NO: 2591 - protein, 101 aa, Artificial Sequence
  CD80 v375 IgV
VIHVTKEVKEVARLSCGHNVSVEELAQTRIYWLKDKKMVLTMMSGDLNIWPEYKNRTIFDITNNLSIMILALRPSDEGTYECVVMKYEKDAFKREHLAEVT

SEQ ID NO: 2592 - protein, 101 aa, Artificial Sequence
  CD80 v376 IgV
VIHVTKEVKEVARLSCGHNVSVEELAQTRIYWLKDKKMVLTMMSGDVNIWPEYKNRTIFDISNNLSIMILALRPSDEGTYECVVMKYEKDAFKREHLAEVT

SEQ ID NO: 2593 - protein, 101 aa, Artificial Sequence
  CD80 v377 IgV
VIHVTKEVKEVARLSCGHNVSVEELAQTRIYWRKDKKIVLTMMSGDLNIWPEYKNRTIFDITNNLSIMILALRPSDEGTYECVVLKYEKDAFKREHLAEVT

SEQ ID NO: 2594 - protein, 101 aa, Artificial Sequence
  CD80 v378 IgV
VIHVTKEVKEVARLSCGHNVSVEELAQTRIYWRKDKKIVLTMMSGDLNIWPEYKNRTIFDITNNLSIMILALRPSDEGTYECVVLKYEKDAFKRVHQAEVT

SEQ ID NO: 2595 - protein, 101 aa, Artificial Sequence
  CD80 v379 IgV
VIHVTKEVKEVARLSCGHNVSVEELAQTRIYWRKDKKIVLTMMSGDLNIWPEYKNRTIFDITNNLSIMILALRPSDEGTYECVVMKYEKDAFKREHLAEVT

SEQ ID NO: 2596 - protein, 101 aa, Artificial Sequence
  CD80 v380 IgV
VIHVTKEVKEVARLSCGHNVSVEELAQTRIYWRKDKKIVLTMMSGDLNIWPEYKNRTIFDITNNLSIMILALRPSDEGTYECVVMKYEKDAFKQEHLAEVT

SEQ ID NO: 2597 - protein, 101 aa, Artificial Sequence
  CD80 v381 IgV
VIHVTKEVKEVARLSCGHNVSVEELAQTRIYWRKDKKMVLTMMSGDLNIWPEYKNRTIFDITNNLSIMILALRPSDEGTYECVVLKYEKDAFKREHLAEVT

SEQ ID NO: 2598 - protein, 101 aa, Artificial Sequence
  CD80 v382 IgV
VIHVTKEVKEVARLSCGHNVSVEELAQTRIYWRKDKKMVLTMMSGDLNIWPEYKNRTIFDITNNLSIMILALRPSDEGTYECVVMKYEKDAFKREHLAEVT

SEQ ID NO: 2599 - protein, 101 aa, Artificial Sequence
  CD80 v383 IgV
VIHVTKEVKEVATLSCGHNVSDEDLAQTRIYWQKDKKMVLTMMSGDLNIWPEYKNRTIFDITNNLSIMILALRPSDEGTYECVVLKYEKDAFKREHLAEVT

SEQ ID NO: 2600 - protein, 101 aa, Artificial Sequence
  CD80 v384 IgV
VIHVTKEVKEVATLSCGHNVSDEDLAQTRIYWQKDKKMVLTMMSGDLNIWPEYKNRTIFDITNNLSIMILALRPSDEGTYECVVMKYEKGAFKREHLAEVT

SEQ ID NO: 2601 - protein, 101 aa, Artificial Sequence
  CD80 v385 IgV
VIHVTKEVKEVATLSCGHNVSDEDLAQTRIYWQKDKKMVLTMMSGDVNIWPEYKNRTIFDITNNLSIMILALRPSDEGTYECVVLKYEKDAFKREHLAEVT

SEQ ID NO: 2602 - protein, 101 aa, Artificial Sequence
  CD80 v386 IgV
VIHVTKEVKEVATLSCGHNVSVEELAQTRIYWQKEKKMVLTMMSGVMNIWPEYKNRTIFDITNNLSIVILALRPSDEGTYECVVLKYEKDAFKREHLAEVT

SEQ ID NO: 2603 - protein, 101 aa, Artificial Sequence
  CD80 v387 IgV
VIHVTKEVKEVATLSCGHNVSVEELAQTRIYWQKEKKMVLTMMSGDLNIWPEYKNRTIFDITNNLSIVILALRPSDEGTYECVVLKYEKDAFKREHLAEVT

SEQ ID NO: 2604 - protein, 101 aa, Artificial Sequence
  CD80 v388 IgV
VIHVTKEVKEVATLSCGHNVSVEELAQTRIYWQKEKKMVLTMMSGDMNIWPEYKNRTIFDITNNLSIMILALRPSDEGTYECVVLKYEKDAFKREHLAEVT

SEQ ID NO: 2605 - protein, 101 aa, Artificial Sequence
  CD80 v389 IgV
VIHVTKEVKEVATLSCGHNVSVEELAQTRIYWQKEKKMVLTMMSGDMNIWPEYKNRTIFDITNNLSIVILALRPSDEGTYECVVQKYEKDAFKREHLAEVT

SEQ ID NO: 2606 - protein, 101 aa, Artificial Sequence
  CD80 v390 IgV
VIHVTKEVKEVATLSCGHNVSVEELAQTRIYWQKDKKMVLTMMSGVMNIWPEYKNRTIFDITNNLSIVILALRPSDEGTYECVVLKYEKDAFKREHLAEVT

SEQ ID NO: 2607 - protein, 101 aa, Artificial Sequence
  CD80 v392 IgV
VIHVTKEVKEVATLSCGHNVSVEELAQTRIYWQKDKKMVLTMMSGDMNIWPEYKNRTIFDITNNLSIMILALRPSDEGTYECVVLKYEKDAFKREHLAEVT

SEQ ID NO: 2608 - protein, 101 aa, Artificial Sequence
  CD80 v393 IgV
VIHVTKEVKEVATLSCGHNVSVEELAQTRIYWQKDKKMVLTMMSGDMNIWPEYKNRTIFDITNNLSIVILALRPSDEGTYECVVQKYEKDAFKREHLAEVT

SEQ ID NO: 2609 - protein, 101 aa, Artificial Sequence
  CD80 v394 IgV
VIHVTKEVKEVATLSCGHNVSVEELAQTRIYWQKEKKMVLTMMSGVLNIWPEYKNRTIFDITNNLSIVILALRPSDEGTYECVVLKYEKDAFKREHLAEVT

SEQ ID NO: 2610 - protein, 101 aa, Artificial Sequence
  CD80 v395 IgV
VIHVTKEVKEVATLSCGHNVSVEELAQTRIYWQKEKKMVLTMMSGVMNIWPEYKNRTIFDITNNLSIMILALRPSDEGTYECVVLKYEKDAFKREHLAEVT

SEQ ID NO: 2611 - protein, 101 aa, Artificial Sequence
  CD80 v396 IgV
VIHVTKEVKEVATLSCGHNVSVEELAQTRIYWQKEKKMVLTMMSGVMNIWPEYKNRTIFDITNNLSIVILALRPSDEGTYECVVQKYEKDAFKREHLAEVT

SEQ ID NO: 2612 - protein, 101 aa, Artificial Sequence
  CD80 v397 IgV
VIHVTKEVKEVATLSCGHNVSVEELAQTRIYWQKEKKMVLTMMSGDLNIWPEYKNRTIFDITNNLSIMILALRPSDEGTYECVVLKYEKDAFKREHLAEVT

SEQ ID NO: 2613 - protein, 101 aa, Artificial Sequence
  CD80 v398 IgV
VIHVTKEVKEVATLSCGHNVSVEELAQTRIYWQKEKKMVLTMMSGDLNIWPEYKNRTIFDITNNLSIVILALRPSDEGTYECVVQKYEKDAFKREHLAEVT

SEQ ID NO: 2614 - protein, 101 aa, Artificial Sequence
  CD80 v399 IgV
VIHVTKEVKEVATLSCGHNVSVEELAQTRIYWQKEKKMVLTMMSGDMNIWPEYKNRTIFDITNNLSIMILALRPSDEGTYECVVQKYEKDAFKREHLAEVT

SEQ ID NO: 2615 - protein, 101 aa, Artificial Sequence
  CD80 v400 IgV
VIHVTKEVKEVATLSCGHNVSVEELAQTRIYWQKDKKMVLTMMSGVLNIWPEYKNRTIFDITNNLSIVILALRPSDEGTYECVVLKYEKDAFKREHLAEVT

SEQ ID NO: 2616 - protein, 101 aa, Artificial Sequence
  CD80 v401 IgV
VIHVTKEVKEVATLSCGHNVSVEELAQTRIYWQKDKKMVLTMMSGVMNIWPEYKNRTIFDITNNLSIMILALRPSDEGTYECVVLKYEKDAFKREHLAEVT

SEQ ID NO: 2617 - protein, 101 aa, Artificial Sequence; identical to SEQ ID NO: 129
  CD80 v402 IgV

SEQ ID NO: 2618 - protein, 101 aa, Artificial Sequence
  CD80 v403 IgV
VIHVTKEVKEVATLSCGHNVSVEELAQTRIYWQKDKKMVLTMMSGDMNIWPEYKNRTIFDITNNLSIMILALRPSDEGTYECVVQKYEKDAFKREHLAEVT

SEQ ID NO: 2619 - protein, 101 aa, Artificial Sequence
  CD80 v404 IgV
VIHVTKEVKEVATLSCGHNVSVEELAQTRIYWQKEKKMVLTMMSGVLNIWPEYKNRTIFDITNNLSIMILALRPSDEGTYECVVLKYEKDAFKREHLAEVT

SEQ ID NO: 2620 - protein, 101 aa, Artificial Sequence
  CD80 v405 IgV
VIHVTKEVKEVATLSCGHNVSVEELAQTRIYWQKEKKMVLTMMSGVLNIWPEYKNRTIFDITNNLSIVILALRPSDEGTYECVVQKYEKDAFKREHLAEVT

SEQ ID NO: 2621 - protein, 101 aa, Artificial Sequence
  CD80 v406 IgV
VIHVTKEVKEVATLSCGHNVSVEELAQTRIYWQKEKKMVLTMMSGVMNIWPEYKNRTIFDITNNLSIMILALRPSDEGTYECVVQKYEKDAFKREHLAEVT

SEQ ID NO: 2622 - protein, 101 aa, Artificial Sequence
  CD80 v407 IgV
VIHVTKEVKEVATLSCGHNVSVEELAQTRIYWQKEKKMVLTMMSGDLNIWPEYKNRTIFDITNNLSIMILALRPSDEGTYECVVQKYEKDAFKREHLAEVT

SEQ ID NO: 2623 - protein, 101 aa, Artificial Sequence
  CD80 v408 IgV
VIHVTKEVKEVATLSCGHNVSVEELAQTRIYWQKDKKMVLTMMSGVLNIWPEYKNRTIFDITNNLSIVILALRPSDEGTYECVVQKYEKDAFKREHLAEVT

SEQ ID NO: 2624 - protein, 101 aa, Artificial Sequence
  CD80 v409 IgV
VIHVTKEVKEVATLSCGHNVSVEELAQTRIYWQKDKKMVLTMMSGVMNIWPEYKNRTIFDITNNLSIMILALRPSDEGTYECVVQKYEKDAFKREHLAEVT

SEQ ID NO: 2625 - protein, 101 aa, Artificial Sequence
  CD80 v410 IgV
VIHVTKEVKEVATLSCGHNVSVEELAQTRIYWQKDKKMVLTMMSGDLNIWPEYKNRTIFDITNNLSIMILALRPSDEGTYECVVQKYEKDAFKREHLAEVT

SEQ ID NO: 2626 - protein, 101 aa, Artificial Sequence
  CD80 v411 IgV
VIHVTKEVKEVATLSCGHNVSVEELAQTRIYWQKEKKMVLTMMSGVLNIWPEYKNRTIFDITNNLSIMILALRPSDEGTYECVVQKYEKDAFKREHLAEVT

SEQ ID NO: 2627 - protein, 101 aa, Artificial Sequence
  CD80 v412 IgV
VIHVTKEVKEVATLSCGHNVSVEELAQTRIYWQKEKKMVLTMMSGDVNIWPEYKNRTIFDITNNLSIVILALRPSDEGTYECVVLKYEKDAFKREHLAEVT

SEQ ID NO: 2628 - protein, 101 aa, Artificial Sequence
  CD80 v413 IgV
VIHVTKEVKEVATLSCGHNVSVEELAQTRIYWQKEKKMVLTMMSGDMKIWPEYKNRTIFDITNNLSIVILALRPSDEGTYECVVLKYEKDAFKREHLAEVT

SEQ ID NO: 2629 - protein, 101 aa, Artificial Sequence
  CD80 v414 IgV
VIHVTKEVKEVATLSCGHNVSVEELAQTRIYWQKEKKMVLTMMSGDMNIWPEYKNRTIFDITNNLSIVILALRPSDEGTYECVVLKYENDAFKREHLAEVT

SEQ ID NO: 2630 - protein, 101 aa, Artificial Sequence
  CD80 v415 IgV
VIHVTKEVKEVATLSCGHNVSVEELAQTRIYWQKDKKMVLTMMSGDMKIWPEYKNRTIFDITNNLSIVILALRPSDEGTYECVVLKYEKDAFKREHLAEVT

SEQ ID NO: 2631 - protein, 101 aa, Artificial Sequence
  CD80 v416 IgV
VIHVTKEVKEVATLSCGHNVSVEELAQTRIYWQKDKKMVLTMMSGDMNIWPEYKNRTIFDITNNLSIVILALRPSDEGTYECVVLKYENDAFKREHLAEVT

SEQ ID NO: 2632 - protein, 101 aa, Artificial Sequence
  CD80 v417 IgV
VIHVTKEVKEVATLSCGHNVSVEELAQTRIYWQKEKKMVLTMMSGDVKIWPEYKNRTIFDITNNLSIVILALRPSDEGTYECVVLKYEKDAFKREHLAEVT

SEQ ID NO: 2633 - protein, 101 aa, Artificial Sequence
  CD80 v418 IgV
VIHVTKEVKEVATLSCGHNVSVEELAQTRIYWQKEKKMVLTMMSGDVNIWPEYKNRTIFDITNNLSIMILALRPSDEGTYECVVLKYEKDAFKREHLAEVT

SEQ ID NO: 2634 - protein, 101 aa, Artificial Sequence
  CD80 v419 IgV
VIHVTKEVKEVATLSCGHNVSVEELAQTRIYWQKEKKMVLTMMSGDVNIWPEYKNRTIFDITNNLSIVILALRPSDEGTYECVVLKYENDAFKREHLAEVT

SEQ ID NO: 2635 - protein, 101 aa, Artificial Sequence
  CD80 v420 IgV
VIHVTKEVKEVATLSCGHNVSVEELAQTRIYWQKEKKMVLTMMSGDMKIWPEYKNRTIFDITNNLSIMILALRPSDEGTYECVVLKYEKDAFKREHLAEVT

SEQ ID NO: 2636 - protein, 101 aa, Artificial Sequence
  CD80 v421 IgV
VIHVTKEVKEVATLSCGHNVSVEELAQTRIYWQKEKKMVLTMMSGDMKIWPEYKNRTIFDITNNLSIVILALRPSDEGTYECVVLKYENDAFKREHLAEVT

SEQ ID NO: 2637 - protein, 101 aa, Artificial Sequence
  CD80 v422 IgV
VIHVTKEVKEVATLSCGHNVSVEELAQTRIYWQKEKKMVLTMMSGDMNIWPEYKNRTIFDITNNLSIMILALRPSDEGTYECVVLKYENDAFKREHLAEVT

SEQ ID NO: 2638 - protein, 101 aa, Artificial Sequence
  CD80 v423 IgV
VIHVTKEVKEVATLSCGHNVSVEELAQTRIYWQKDKKMVLTMMSGDVKIWPEYKNRTIFDITNNLSIVILALRPSDEGTYECVVLKYEKDAFKREHLAEVT

SEQ ID NO: 2639 - protein, 101 aa, Artificial Sequence
  CD80 v424 IgV
VIHVTKEVKEVATLSCGHNVSVEELAQTRIYWQKDKKMVLTMMSGDVNIWPEYKNRTIFDITNNLSIMILALRPSDEGTYECVVLKYEKDAFKREHLAEVT

SEQ ID NO: 2640 - protein, 101 aa, Artificial Sequence
  CD80 v425 IgV
VIHVTKEVKEVATLSCGHNVSVEELAQTRIYWQKDKKMVLTMMSGDVNIWPEYKNRTIFDITNNLSIVILALRPSDEGTYECVVLKYENDAFKREHLAEVT

SEQ ID NO: 2641 - protein, 101 aa, Artificial Sequence
  CD80 v426 IgV
VIHVTKEVKEVATLSCGHNVSVEELAQTRIYWQKDKKMVLTMMSGDMKIWPEYKNRTIFDITNNLSIMILALRPSDEGTYECVVLKYEKDAFKREHLAEVT

SEQ ID NO: 2642 - protein, 101 aa, Artificial Sequence
  CD80 v427 IgV
VIHVTKEVKEVATLSCGHNVSVEELAQTRIYWQKDKKMVLTMMSGDMKIWPEYKNRTIFDITNNLSIVILALRPSDEGTYECVVLKYENDAFKREHLAEVT

SEQ ID NO: 2643 - protein, 101 aa, Artificial Sequence
  CD80 v428 IgV
VIHVTKEVKEVATLSCGHNVSVEELAQTRIYWQKDKKMVLTMMSGDMNIWPEYKNRTIFDITNNLSIMILALRPSDEGTYECVVLKYENDAFKREHLAEVT

SEQ ID NO: 2644 - protein, 101 aa, Artificial Sequence
  CD80 v429 IgV
VIHVTKEVKEVATLSCGHNVSVEELAQTRIYWQKEKKMVLTMMSGDVKIWPEYKNRTIFDITNNLSIMILALRPSDEGTYECVVLKYEKDAFKREHLAEVT

SEQ ID NO: 2645 - protein, 101 aa, Artificial Sequence
  CD80 v430 IgV
VIHVTKEVKEVATLSCGHNVSVEELAQTRIYWQKEKKMVLTMMSGDVKIWPEYKNRTIFDITNNLSIVILALRPSDEGTYECVVLKYENDAFKREHLAEVT

SEQ ID NO: 2646 - protein, 101 aa, Artificial Sequence
  CD80 v431 IgV
VIHVTKEVKEVATLSCGHNVSVEELAQTRIYWQKEKKMVLTMMSGDVNIWPEYKNRTIFDITNNLSIMILALRPSDEGTYECVVLKYENDAFKREHLAEVT

SEQ ID NO: 2647 - protein, 101 aa, Artificial Sequence
  CD80 v432 IgV
VIHVTKEVKEVATLSCGHNVSVEELAQTRIYWQKEKKMVLTMMSGDMKIWPEYKNRTIFDITNNLSIMILALRPSDEGTYECVVLKYENDAFKREHLAEVT

SEQ ID NO: 2648 - protein, 101 aa, Artificial Sequence
  CD80 v433 IgV
VIHVTKEVKEVATLSCGHNVSVEELAQTRIYWQKDKKMVLTMMSGDVKIWPEYKNRTIFDITNNLSIVILALRPSDEGTYECVVLKYENDAFKREHLAEVT

SEQ ID NO: 2649 - protein, 101 aa, Artificial Sequence
  CD80 v434 IgV
VIHVTKEVKEVATLSCGHNVSVEELAQTRIYWQKDKKMVLTMMSGDVNIWPEYKNRTIFDITNNLSIMILALRPSDEGTYECVVLKYENDAFKREHLAEVT

SEQ ID NO: 2650 - protein, 101 aa, Artificial Sequence
  CD80 v435 IgV
VIHVTKEVKEVATLSCGHNVSVEELAQTRIYWQKDKKMVLTMMSGDMKIWPEYKNRTIFDITNNLSIMILALRPSDEGTYECVVLKYENDAFKREHLAEVT

SEQ ID NO: 2651 - protein, 101 aa, Artificial Sequence
  CD80 v436 IgV
VIHVTKEVKEVATLSCGHNVSVEELAQTRIYWQKEKKMVLTMMSGDVKIWPEYKNRTIFDITNNLSIMILALRPSDEGTYECVVLKYENDAFKREHLAEVT

SEQ ID NO: 2652 - protein, 101 aa, Artificial Sequence
  CD80 v437 IgV
VIHVTKEVKEVATLSCGHNVSVEELAQTRIYWQKDKKMVLTMMSGVVKIWPEYKNRTIFDITNNLSIMILALRPSDEGTYECVVLKYEKDAFKREHLAEVT

SEQ ID NO: 2653 - protein, 101 aa, Artificial Sequence
  CD80 v438 IgV
VIHVTKEVKEVATLSCGHNVSVEELAQTRIYWQKDKKMVLTMMSGVVNIWPEYKNRTIFDITNNLSIMILALRPSDEGTYECVVQKYEKDAFKREHLAEVT

SEQ ID NO: 2654 - protein, 101 aa, Artificial Sequence
  CD80 v439 IgV
VIHVTKEVKEVATLSCGHNVSVEELAQTRIYWQKDKKMVLTMMSGVVNIWPEYKNRTIFDITNNLSIMILALRPSDEGTYECVVLKYENDAFKREHLAEVT

SEQ ID NO: 2655 - protein, 101 aa, Artificial Sequence
  CD80 v440 IgV
VIHVTKEVKEVATLSCGHNVSVEELAQTRIYWQKDKKMVLTMMSGDVKIWPEYKNRTIFDITNNLSIMILALRPSDEGTYECVVQKYEKDAFKREHLAEVT

SEQ ID NO: 2656 - protein, 101 aa, Artificial Sequence
  CD80 v441 IgV
VIHVTKEVKEVATLSCGHNVSVEELAQTRIYWQKDKKMVLTMMSGDVNIWPEYKNRTIFDITNNLSIMILALRPSDEGTYECVVQKYENDAFKREHLAEVT

SEQ ID NO: 2657 - protein, 101 aa, Artificial Sequence
  CD80 v442 IgV
VIHVTKEVKEVATLSCGHNVSVEELEQTRIYWQKDKKMVLTMMSGDLNIWPEYKNRTIFDITNNLSIMILGLRPSDEGTYECVVLKYEKGAFKREHLAEVT

SEQ ID NO: 2658 - protein, 101 aa, Artificial Sequence
  CD80 v443 IgV
VIHVTKEVKEVATLSCGYNVSVEELAQTRIYWQKDKKMVLTMMSGDLNIWPEYKNRTIFDITNNLSIMILGLRPSDEGTYECVVLKYEKGAFKREHLAEVT

SEQ ID NO: 2659 - protein, 101 aa, Artificial Sequence
  CD80 v444 IgV
VIHVTKEVKEVATLSCGYNVSVEELEQTRIYWQKEKKMVLTMMSGDLNIWPEYKNRTIFDITNNLSIMILGLRPSDEGTYECVVLKYEKGAFKREHLAEVT

SEQ ID NO: 2660 - protein, 101 aa, Artificial Sequence
  CD80 v445 IgV
VIHVTKEVKEVATLSCGYNVSVEELEQTRIYWQKDKKMVLTMMSGDMNIWPEYKNRTIFDITNNLSIMILGLRPSDEGTYECVVLKYEKGAFKREHLAEVT

SEQ ID NO: 2661 - protein, 101 aa, Artificial Sequence
  CD80 v446 IgV
VIHVTKEVKEVATLSCGYNVSVEELEQTRIYWQKDKKMVLTMMSGDLNIWPEYKNRTIFDITNNLSIVILGLRPSDEGTYECVVLKYEKGAFKREHLAEVT

SEQ ID NO: 2662 - protein, 101 aa, Artificial Sequence
  CD80 v447 IgV
VIHVTKEVKEVATLSCGYNVSVEELEQTRIYWQKDKKMVLTMMSGDLNIWPEYKNRTIFDITNNLSIMILALRPSDEGTYECVVLKYEKGAFKREHLAEVT

SEQ ID NO: 2663 - protein, 101 aa, Artificial Sequence
  CD80 v448 IgV
VIHVTKEVKEVATLSCGYNVSVEELEQTRIYWQKDKKMVLTMMSGDLNIWPEYKNRTIFDITNNLSIMILGLRPSDEGTYECVVLKYEKDAFKREHLAEVT

SEQ ID NO: 2664 - protein, 101 aa, Artificial Sequence
  CD80 v449 IgV
VIHVTKEVKEVATLSCGHNVSVEELAQTRIYWQKDKKMVLTMMSGDLNIWPEYKNRTIFDITNNLSIMILGLRPSDEGTYECVVLKYEKGAFKREHLAEVT

SEQ ID NO: 2665 - protein, 101 aa, Artificial Sequence
  CD80 v450 IgV
VIHVTKEVKEVATLSCGYNVSVEELAQTRIYWQKEKKMVLTMMSGDLNIWPEYKNRTIFDITNNLSIMILGLRPSDEGTYECVVLKYEKGAFKREHLAEVT

SEQ ID NO: 2666 - protein, 101 aa, Artificial Sequence
  CD80 v451 IgV
VIHVTKEVKEVATLSCGYNVSVEELEQTRIYWQKEKKMVLTMMSGDMNIWPEYKNRTIFDITNNLSIMILGLRPSDEGTYECVVLKYEKGAFKREHLAEVT

SEQ ID NO: 2667 - protein, 101 aa, Artificial Sequence
  CD80 v452 IgV
VIHVTKEVKEVATLSCGYNVSVEELEQTRIYWQKDKKMVLTMMSGDMNIWPEYKNRTIFDITNNLSIVILGLRPSDEGTYECVVLKYEKGAFKREHLAEVT

SEQ ID NO: 2668 - protein, 101 aa, Artificial Sequence
  CD80 v453 IgV
VIHVTKEVKEVATLSCGYNVSVEELEQTRIYWQKDKKMVLTMMSGDLNIWPEYKNRTIFDITNNLSIVILALRPSDEGTYECVVLKYEKGAFKREHLAEVT

SEQ ID NO: 2669 - protein, 101 aa, Artificial Sequence
  CD80 v454 IgV
VIHVTKEVKEVATLSCGYNVSVEELEQTRIYWQKDKKMVLTMMSGDLNIWPEYKNRTIFDITNNLSIMILALRPSDEGTYECVVLKYEKDAFKREHLAEVT

SEQ ID NO: 2670 - protein, 101 aa, Artificial Sequence
  CD80 v455 IgV
VIHVTKEVKEVATLSCGHNVSVEELEQTRIYWQKEKKMVLTMMSGDLNIWPEYKNRTIFDITNNLSIMILGLRPSDEGTYECVVLKYEKGAFKREHLAEVT

SEQ ID NO: 2671 - protein, 101 aa, Artificial Sequence
  CD80 v456 IgV
VIHVTKEVKEVATLSCGHNVSVEELEQTRIYWQKDKKMVLTMMSGDMNIWPEYKNRTIFDITNNLSIMILGLRPSDEGTYECVVLKYEKGAFKREHLAEVT

SEQ ID NO: 2672 - protein, 101 aa, Artificial Sequence
  CD80 v457 IgV
VIHVTKEVKEVATLSCGHNVSVEELEQTRIYWQKDKKMVLTMMSGDLNIWPEYKNRTIFDITNNLSIVILGLRPSDEGTYECVVLKYEKGAFKREHLAEVT

SEQ ID NO: 2673 - protein, 101 aa, Artificial Sequence
  CD80 v458 IgV
VIHVTKEVKEVATLSCGHNVSVEELEQTRIYWQKDKKMVLTMMSGDLNIWPEYKNRTIFDITNNLSIMILALRPSDEGTYECVVLKYEKGAFKREHLAEVT

SEQ ID NO: 2674 - protein, 101 aa, Artificial Sequence
  CD80 v459 IgV
VIHVTKEVKEVATLSCGHNVSVEELEQTRIYWQKDKKMVLTMMSGDLNIWPEYKNRTIFDITNNLSIMILGLRPSDEGTYECVVLKYEKDAFKREHLAEVT

SEQ ID NO: 2675 - protein, 101 aa, Artificial Sequence
  CD80 v460 IgV
VIHVTKEVKEVATLSCGYNVSVEELAQTRIYWQKDKKMVLTMMSGDMNIWPEYKNRTIFDITNNLSIMILGLRPSDEGTYECVVLKYEKGAFKREHLAEVT

SEQ ID NO: 2676 - protein, 101 aa, Artificial Sequence
  CD80 v461 IgV
VIHVTKEVKEVATLSCGYNVSVEELAQTRIYWQKDKKMVLTMMSGDLNIWPEYKNRTIFDITNNLSIVILGLRPSDEGTYECVVLKYEKGAFKREHLAEVT

SEQ ID NO: 2677 - protein, 101 aa, Artificial Sequence
  CD80 v462 IgV
VIHVTKEVKEVATLSCGYNVSVEELAQTRIYWQKDKKMVLTMMSGDLNIWPEYKNRTIFDITNNLSIMILALRPSDEGTYECVVLKYEKGAFKREHLAEVT

SEQ ID NO: 2678 - protein, 101 aa, Artificial Sequence
  CD80 v463 IgV
VIHVTKEVKEVATLSCGYNVSVEELAQTRIYWQKDKKMVLTMMSGDLNIWPEYKNRTIFDITNNLSIMILGLRPSDEGTYECVVLKYEKDAFKREHLAEVT

SEQ ID NO: 2679 - protein, 101 aa, Artificial Sequence
  CD80 v464 IgV
VIHVTKEVKEVATLSCGYNVSVEELEQTRIYWQKEKKMVLTMMSGDLNIWPEYKNRTIFDITNNLSIVILGLRPSDEGTYECVVLKYEKGAFKREHLAEVT

SEQ ID NO: 2680 - protein, 101 aa, Artificial Sequence
  CD80 v465 IgV
VIHVTKEVKEVATLSCGYNVSVEELEQTRIYWQKEKKMVLTMMSGDLNIWPEYKNRTIFDITNNLSIMILALRPSDEGTYECVVLKYEKGAFKREHLAEVT

SEQ ID NO: 2681 - protein, 101 aa, Artificial Sequence
  CD80 v466 IgV
VIHVTKEVKEVATLSCGYNVSVEELEQTRIYWQKEKKMVLTMMSGDLNIWPEYKNRTIFDITNNLSIMILGLRPSDEGTYECVVLKYEKDAFKREHLAEVT

SEQ ID NO: 2682 - protein, 101 aa, Artificial Sequence
  CD80 v467 IgV
VIHVTKEVKEVATLSCGYNVSVEELEQTRIYWQKDKKMVLTMMSGDMNIWPEYKNRTIFDITNNLSIMILALRPSDEGTYECVVLKYEKGAFKREHLAEVT

SEQ ID NO: 2683 - protein, 101 aa, Artificial Sequence
  CD80 v468 IgV
VIHVTKEVKEVATLSCGYNVSVEELEQTRIYWQKDKKMVLTMMSGDMNIWPEYKNRTIFDITNNLSIMILGLRPSDEGTYECVVLKYEKDAFKREHLAEVT

SEQ ID NO: 2684 - protein, 101 aa, Artificial Sequence
  CD80 v469 IgV
VIHVTKEVKEVATLSCGYNVSVEELEQTRIYWQKDKKMVLTMMSGDLNIWPEYKNRTIFDITNNLSIVILGLRPSDEGTYECVVLKYEKDAFKREHLAEVT

SEQ ID NO: 2685 - protein, 101 aa, Artificial Sequence
  CD80 v470 IgV
VIHVTKEVKEVATLSCGHNVSVEELAQTRIYWQKEKKMVLTMMSGDLNIWPEYKNRTIFDITNNLSIMILGLRPSDEGTYECVVLKYEKGAFKREHLAEVT

SEQ ID NO: 2686 - protein, 101 aa, Artificial Sequence
  CD80 v471 IgV
VIHVTKEVKEVATLSCGYNVSVEELAQTRIYWQKEKKMVLTMMSGDMNIWPEYKNRTIFDITNNLSIMILGLRPSDEGTYECVVLKYEKGAFKREHLAEVT

SEQ ID NO: 2687 - protein, 101 aa, Artificial Sequence
  CD80 v472 IgV
VIHVTKEVKEVATLSCGYNVSVEELEQTRIYWQKEKKMVLTMMSGDMNIWPEYKNRTIFDITNNLSIVILGLRPSDEGTYECVVLKYEKGAFKREHLAEVT

SEQ ID NO: 2688 - protein, 101 aa, Artificial Sequence
  CD80 v473 IgV
VIHVTKEVKEVATLSCGYNVSVEELEQTRIYWQKDKKMVLTMMSGDMNIWPEYKNRTIFDITNNLSIVILALRPSDEGTYECVVLKYEKGAFKREHLAEVT

SEQ ID NO: 2689 - protein, 101 aa, Artificial Sequence
  CD80 v474 IgV
VIHVTKEVKEVATLSCGYNVSVEELEQTRIYWQKDKKMVLTMMSGDLNIWPEYKNRTIFDITNNLSIVILALRPSDEGTYECVVLKYEKDAFKREHLAEVT

SEQ ID NO: 2690 - protein, 101 aa, Artificial Sequence
  CD80 v475 IgV
VIHVTKEVKEVATLSCGHNVSVEELAQTRIYWQKDKKMVLTMMSGDMNIWPEYKNRTIFDITNNLSIMILGLRPSDEGTYECVVLKYEKGAFKREHLAEVT

SEQ ID NO: 2691 - protein, 101 aa, Artificial Sequence
  CD80 v476 IgV
VIHVTKEVKEVATLSCGHNVSVEELAQTRIYWQKDKKMVLTMMSGDLNIWPEYKNRTIFDITNNLSIVILGLRPSDEGTYECVVLKYEKGAFKREHLAEVT

SEQ ID NO: 2692 - protein, 101 aa, Artificial Sequence
  CD80 v477 IgV
VIHVTKEVKEVATLSCGHNVSVEELAQTRIYWQKDKKMVLTMMSGDLNIWPEYKNRTIFDITNNLSIMILALRPSDEGTYECVVLKYEKGAFKREHLAEVT

SEQ ID NO: 2693 - protein, 101 aa, Artificial Sequence
  CD80 v478 IgV
VIHVTKEVKEVATLSCGHNVSVEELAQTRIYWQKDKKMVLTMMSGDLNIWPEYKNRTIFDITNNLSIMILGLRPSDEGTYECVVLKYEKDAFKREHLAEVT

SEQ ID NO: 2694 - protein, 101 aa, Artificial Sequence
  CD80 v479 IgV
VIHVTKEVKEVATLSCGHNVSVEELEQTRIYWQKEKKMVLTMMSGDMNIWPEYKNRTIFDITNNLSIMILGLRPSDEGTYECVVLKYEKGAFKREHLAEVT

SEQ ID NO: 2695 - protein, 101 aa, Artificial Sequence
  CD80 v480 IgV
VIHVTKEVKEVATLSCGHNVSVEELEQTRIYWQKEKKMVLTMMSGDLNIWPEYKNRTIFDITNNLSIVILGLRPSDEGTYECVVLKYEKGAFKREHLAEVT

SEQ ID NO: 2696 - protein, 101 aa, Artificial Sequence
  CD80 v481 IgV
VIHVTKEVKEVATLSCGHNVSVEELEQTRIYWQKEKKMVLTMMSGDLNIWPEYKNRTIFDITNNLSIMILALRPSDEGTYECVVLKYEKGAFKREHLAEVT

SEQ ID NO: 2697 - protein, 101 aa, Artificial Sequence
  CD80 v482 IgV
VIHVTKEVKEVATLSCGHNVSVEELEQTRIYWQKEKKMVLTMMSGDLNIWPEYKNRTIFDITNNLSIMILGLRPSDEGTYECVVLKYEKDAFKREHLAEVT

SEQ ID NO: 2698 - protein, 101 aa, Artificial Sequence
  CD80 v483 IgV
VIHVTKEVKEVATLSCGHNVSVEELEQTRIYWQKDKKMVLTMMSGDMNIWPEYKNRTIFDITNNLSIVILGLRPSDEGTYECVVLKYEKGAFKREHLAEVT

SEQ ID NO: 2699 - protein, 101 aa, Artificial Sequence
  CD80 v484 IgV
VIHVTKEVKEVATLSCGHNVSVEELEQTRIYWQKDKKMVLTMMSGDMNIWPEYKNRTIFDITNNLSIMILALRPSDEGTYECVVLKYEKGAFKREHLAEVT

SEQ ID NO: 2700 - protein, 101 aa, Artificial Sequence
  CD80 v485 IgV
VIHVTKEVKEVATLSCGHNVSVEELEQTRIYWQKDKKMVLTMMSGDMNIWPEYKNRTIFDITNNLSIMILGLRPSDEGTYECVVLKYEKDAFKREHLAEVT

SEQ ID NO: 2701 - protein, 101 aa, Artificial Sequence
  CD80 v486 IgV
VIHVTKEVKEVATLSCGHNVSVEELEQTRIYWQKDKKMVLTMMSGDLNIWPEYKNRTIFDITNNLSIVILALRPSDEGTYECVVLKYEKGAFKREHLAEVT

SEQ ID NO: 2702 - protein, 101 aa, Artificial Sequence
  CD80 v487 IgV
VIHVTKEVKEVATLSCGHNVSVEELEQTRIYWQKDKKMVLTMMSGDLNIWPEYKNRTIFDITNNLSIMILALRPSDEGTYECVVLKYEKDAFKREHLAEVT

SEQ ID NO: 2703 - protein, 101 aa, Artificial Sequence
  CD80 v488 IgV
VIHVTKEVKEVATLSCGYNVSVEELAQTRIYWQKEKKMVLTMMSGDLNIWPEYKNRTIFDITNNLSIVILGLRPSDEGTYECVVLKYEKGAFKREHLAEVT

SEQ ID NO: 2704 - protein, 101 aa, Artificial Sequence
  CD80 v489 IgV
VIHVTKEVKEVATLSCGYNVSVEELAQTRIYWQKEKKMVLTMMSGDLNIWPEYKNRTIFDITNNLSIMILALRPSDEGTYECVVLKYEKGAFKREHLAEVT

SEQ ID NO: 2705 - protein, 101 aa, Artificial Sequence
  CD80 v490 IgV
VIHVTKEVKEVATLSCGYNVSVEELAQTRIYWQKEKKMVLTMMSGDLNIWPEYKNRTIFDITNNLSIMILGLRPSDEGTYECVVLKYEKDAFKREHLAEVT

SEQ ID NO: 2706 - protein, 101 aa, Artificial Sequence
  CD80 v491 IgV
VIHVTKEVKEVATLSCGYNVSVEELAQTRIYWQKDKKMVLTMMSGDMNIWPEYKNRTIFDITNNLSIVILGLRPSDEGTYECVVLKYEKGAFKREHLAEVT

SEQ ID NO: 2707 - protein, 101 aa, Artificial Sequence
  CD80 v492 IgV
VIHVTKEVKEVATLSCGYNVSVEELAQTRIYWQKDKKMVLTMMSGDMNIWPEYKNRTIFDITNNLSIMILALRPSDEGTYECVVLKYEKGAFKREHLAEVT

SEQ ID NO: 2708 - protein, 101 aa, Artificial Sequence
  CD80 v493 IgV
VIHVTKEVKEVATLSCGYNVSVEELAQTRIYWQKDKKMVLTMMSGDMNIWPEYKNRTIFDITNNLSIMILGLRPSDEGTYECVVLKYEKDAFKREHLAEVT

SEQ ID NO: 2709 - protein, 101 aa, Artificial Sequence
  CD80 v494 IgV
VIHVTKEVKEVATLSCGYNVSVEELAQTRIYWQKDKKMVLTMMSGDLNIWPEYKNRTIFDITNNLSIVILALRPSDEGTYECVVLKYEKGAFKREHLAEVT

SEQ ID NO: 2710 - protein, 101 aa, Artificial Sequence
  CD80 v495 IgV
VIHVTKEVKEVATLSCGYNVSVEELAQTRIYWQKDKKMVLTMMSGDLNIWPEYKNRTIFDITNNLSIVILGLRPSDEGTYECVVLKYEKDAFKREHLAEVT

SEQ ID NO: 2711 - protein, 101 aa, Artificial Sequence
  CD80 v496 IgV
VIHVTKEVKEVATLSCGYNVSVEELAQTRIYWQKDKKMVLTMMSGDLNIWPEYKNRTIFDITNNLSIMILALRPSDEGTYECVVLKYEKDAFKREHLAEVT

SEQ ID NO: 2712 - protein, 101 aa, Artificial Sequence
  CD80 v497 IgV
VIHVTKEVKEVATLSCGYNVSVEELEQTRIYWQKEKKMVLTMMSGDMNIWPEYKNRTIFDITNNLSIMILALRPSDEGTYECVVLKYEKGAFKREHLAEVT

SEQ ID NO: 2713 - protein, 101 aa, Artificial Sequence
  CD80 v498 IgV
VIHVTKEVKEVATLSCGYNVSVEELEQTRIYWQKEKKMVLTMMSGDMNIWPEYKNRTIFDITNNLSIMILGLRPSDEGTYECVVLKYEKDAFKREHLAEVT

SEQ ID NO: 2714 - protein, 101 aa, Artificial Sequence
  CD80 v499 IgV
VIHVTKEVKEVATLSCGYNVSVEELEQTRIYWQKEKKMVLTMMSGDLNIWPEYKNRTIFDITNNLSIVILALRPSDEGTYECVVLKYEKGAFKREHLAEVT

SEQ ID NO: 2715 - protein, 101 aa, Artificial Sequence
  CD80 v500 IgV
VIHVTKEVKEVATLSCGYNVSVEELEQTRIYWQKEKKMVLTMMSGDLNIWPEYKNRTIFDITNNLSIVILGLRPSDEGTYECVVLKYEKDAFKREHLAEVT

SEQ ID NO: 2716 - protein, 101 aa, Artificial Sequence
  CD80 v501 IgV
VIHVTKEVKEVATLSCGYNVSVEELEQTRIYWQKEKKMVLTMMSGDLNIWPEYKNRTIFDITNNLSIMILALRPSDEGTYECVVLKYEKDAFKREHLAEVT

SEQ ID NO: 2717 - protein, 101 aa, Artificial Sequence
  CD80 v502 IgV
VIHVTKEVKEVATLSCGYNVSVEELEQTRIYWQKDKKMVLTMMSGDMNIWPEYKNRTIFDITNNLSIVILGLRPSDEGTYECVVLKYEKDAFKREHLAEVT

SEQ ID NO: 2718 - protein, 101 aa, Artificial Sequence
  CD80 v503 IgV
VIHVTKEVKEVATLSCGYNVSVEELEQTRIYWQKDKKMVLTMMSGDMNIWPEYKNRTIFDITNNLSIMILALRPSDEGTYECVVLKYEKDAFKREHLAEVT

SEQ ID NO: 2719 - protein, 107 aa, Artificial Sequence
  CD80 v292 IgV
VIHVTKEVKEVATLSCGHNVSVEELAQTRIYWQKDKKMVLTMMSGDMKIWPEYKNRTIFDITNNLSIVILAVRPSDEGTYECVVLKYEKDAFKREHLAEVTLSVKAD

SEQ ID NO: 2720 - protein, 107 aa, Artificial Sequence
  CD80 v293 IgV
VIHVTKEVKEVATLSCGHNVSVEELAQTRIYWQKDKKMVLSMMSGDMTIWPEYKNRTIFDITNNLSIVILALRPSDEGTYECVVLKYEKDAFKREHLAEVTLSVKAD

SEQ ID NO: 2721 - protein, 107 aa, Artificial Sequence
  CD80 v294 IgV
VIHVTKEVKEVATLSCGHNVSVEELAQTRIYWQKEKKMVLTMMSGVINIWPEYKNRTIFDITNNLSIVILGLRPSDEGTYECVVLKYEKDAFKREHLAEVTLSVKAD

SEQ ID NO: 2722 - protein, 107 aa, Artificial Sequence
  CD80 v295 IgV
VIHVTKEVKEVATLSCGHNVSVEELAQTRIYWQKEKKMVLTMMSGDINIWPEYKNRTIFDITNNLSIVILGLRPSDEGTYECVVLKYEKDAFKREHLAEVTLSVKAD

SEQ ID NO: 2723 - protein, 107 aa, Artificial Sequence
  CD80 v296 IgV
VIHVTKEVKEVATLSCGHNVSVEELAQTRIYWQKDKKMVLTMISGDLNIWPEYKNRTIFDITNNLSIVILALRPSDEGTYECVVMKYEKDAFKREHLAEVTLSVKAD

SEQ ID NO: 2724 - protein, 107 aa, Artificial Sequence
  CD80 v297 IgV
VIHVTKEVKEVATLSCGHNVSVEELAQTRIYWQKDKKMVLTMISGEMNIWPEYKNRTIFDITNNLSIVILGLRPSDEGTYECVVMKYEKDAFKREHLAEVTLSVKAD

SEQ ID NO: 2725 - protein, 107 aa, Artificial Sequence
  CD80 v298 IgV
VIHVTKEVKEVATLSCGYNVSVEELAQTRIYWQKDKKMVLTMMSGDLNIWPEYKNRTIFDITNNLSIVILGLRPSDEGTYECVVLKYEKDSFKREHLAEVTLSVKAD

SEQ ID NO: 2726 - protein, 107 aa, Artificial Sequence
  CD80 v299 IgV
VIHVTKEVKEVATLSCGHNVSVEELAQTRIYWQKDKKMVLTMMSGDIKIWPEYKNRTIFDFTNNLSIVILALRPSDEGTYECVVLKYEKDAFKREHLAEVTLSVKAD

SEQ ID NO: 2727 - protein, 107 aa, Artificial Sequence
  CD80 v300 IgV
VIHVTKEVKEVATLSCGHNVSVEELAQTRIYWQKDKKMVLTMMSGDVNIWPEYKNRTIFDISNNLSIVILALRPSDEGTYECVVQKYEKDAFKREHLAEVTLSVKAD

SEQ ID NO: 2728 - protein, 107 aa, Artificial Sequence
  CD80 v301 IgV
VIHVTKEVKEVATLSCGHNVSVEELAQTRIYWQKEKKMVLTMISGDLNIWPEYKNRTIFDITNNLSIVILGLRPSDEGTYECVVLKYEKDAFKREHLAEVTLSVKAD

SEQ ID NO: 2729 - protein, 107 aa, Artificial Sequence
  CD80 v302 IgV
VIHVTKEVKEVATLSCGHNVSVEELAQTRIYWQKDKKMVLTMMSGDVNIWPEYKNRTIFDITNNLSIVILALRPSDEGTYECVVLKYEKDAFKREHLAEVTLSVKAD

SEQ ID NO: 2730 - protein, 107 aa, Artificial Sequence
  CD80 v303 IgV
VIHVTKEVKEVATLSCGHNVSVEELAQTRIYWQKDKKMVLTMMSGDLNIWPEYKNRTIFDITNNLSIVILGLRPSDEGTYECVVMKYEKDAFKREHLAEVTLSVKAD

SEQ ID NO: 2731 - protein, 107 aa, Artificial Sequence
  CD80 v304 IgV
VIHVTKEVKEVATLSCGHNVSAEELAQTRIYWQKDKKMVLTMMSGDLNIWPEYKNRTIFDITNNLSIVILGLRPSDEGTYECVVLKYEKDAFKREHLAEVTLSVKAD

SEQ ID NO: 2732 - protein, 107 aa, Artificial Sequence
  CD80 v305 IgV
VIHVTKEVKEVATLSCGHNVSVEELAQTRIYWQKDKKMVLTMMSGDLNIWPEYKNRTIFDITNNLSIVILGLRPSDEGTYECVVLKYEKDAFKREHLAEVTLSVKAD

SEQ ID NO: 2733 - protein, 107 aa, Artificial Sequence
  CD80 v306 IgV
VIHVTKEVKEVATLSCGHNVSVEELAQTRIYWQKDKKMVLTMMSGEINIWPEYKNRTIFDITNNLSIVILALRPSDEGTYECVVLKYEKDAFKREHLAEVTLSVKAD

SEQ ID NO: 2734 - protein, 107 aa, Artificial Sequence
  CD80 v307 IgV
VIHVTKEVKEVATLSCGHNVSVEELAHTRIYWQKDKKMVLTMMSGDINIWPEYKNRTIFDITNNLSIVILALRPSDEGTYECVVLKYEKDAFKREHLAEVTLSVKAD

SEQ ID NO: 2735 - protein, 107 aa, Artificial Sequence
  CD80 v308 IgV
VIHVTKEVKEVATLSCGHNVSVEELAQTRIYWQKDKKMVLTMMSGEMNIWPEYKNRTIFDITNNLSIVILALRPSDEGTYECVVMKYEKDAFKREHLAEVTLSVKAD

SEQ ID NO: 2736 - protein, 107 aa, Artificial Sequence
  CD80 v309 IgV
VIHVTKEVKEVATLSCGHNVSVEELAQTRIYWQKDKKMVLTMMSGEMNIWPEYKNRTIFDITNNLSIVILALRPSDEGTYECVVLKYEKDGFKREHLAEVTLSVKAD

SEQ ID NO: 2737 - protein, 107 aa, Artificial Sequence
  CD80 v310 IgV
VIHVTKEVKEVATLSCGHNVSVEELAQTRIYWQKDKKMVLTMMSGEMNIWPEYKNRTIFDITNNLSIVILALRPSDEGTYECVVLKYEKDAFKREHLAEVTLSVKAD

SEQ ID NO: 2738 - protein, 107 aa, Artificial Sequence
  CD80 v311 IgV
VIHVTKEVKEVATLSCGHNVSVEELAQTRIYWQKDKKMVLTMMSGDMNIWPEYKNRTIFDITNNLSIVILALRPSDEGTYECVVLKYEKDAFKREHRAEVTLSVKAD

SEQ ID NO: 2739 - protein, 107 aa, Artificial Sequence
  CD80 v312 IgV
VIHVTKEVKEVATLSCGYNVSVEELAQTRIYWQKDKKMVLTMMSGDMNIWPEYKNRTIFDITNNLSIVILALRPSDEGTYECVVLKYEKDAFKREHLAEVTLSVKAD

SEQ ID NO: 2740 - protein, 107 aa, Artificial Sequence
  CD80 v313 IgV
VIHVTKEVKEVATLSCGHNVSVEELALTRIYWQKDKKMVLTMMSGDVNIWPEYKNRTIFDVTNNLSIVILALRPSDEGTYECVVMKYEKDAFKREHLAEVTLSVKAD

SEQ ID NO: 2741 - protein, 107 aa, Artificial Sequence
  CD80 v314 IgV
VIHVTKEVKEVATLSCGHNVSVEELAQTRIYWQKDKKMVLTMMSGDVNIWPEYKNRTIFDVTNNLSIVILALRPSDEGTYECVVMKYEKDAFKREHLAEVTLSVKAD

SEQ ID NO: 2742 - protein, 107 aa, Artificial Sequence
  CD80 v315 IgV
VIHVTKEVKEVATLSCGHNVSVEELAQTRIYWQKDKKMVLTMMSGDVNIWPEYKNRTIFDITNNLSIVILALRPSDEGTYECVVMKYEKDAFKQEHLAEVTLSVKAD

SEQ ID NO: 2743 - protein, 107 aa, Artificial Sequence
  CD80 v316 IgV
VIHVTKEVKEVATLSCGHNVSVEELAQTRIYWQKDKKMVLTMMSGDVKIWPEYKNRTIFDITNNLSIVILALRPSDEGTYECVVMKYEKDAFKREHLAEVTLSVKAD

SEQ ID NO: 2744 - protein, 107 aa, Artificial Sequence
  CD80 v317 IgV
VIHVTKEVKEVATLSCGYNVSVEELAQTRIYWQKDKKMVLTMMSGDVKIWPEYKNRTIFDITNNLSIVILALRPSDEGTYECVVLKYEKDAFKREHLAEVTLSVKAD

SEQ ID NO: 2745 - protein, 107 aa, Artificial Sequence
  CD80 v318 IgV
VIHVTKEVKEVATLSCGHNVSVEELERTRIYWQKDKKMVLTMMSGDLYIWPEYKNRTIFDITNNLSIVILALRPSDEGTYECVVQKYEKDAFKREHLAEVTLSVKAD

SEQ ID NO: 2746 - protein, 107 aa, Artificial Sequence
  CD80 v319 IgV
VIHVTKEVKEVATLSCGHNVSVEELAQTRIYWQKDKKMVLTMMSGELNIWPEYKNRTIFDITNNLSIMILALRPSDEGTYECVVQKYEKDALKREHLAEVTLSVKAD

SEQ ID NO: 2747 - protein, 107 aa, Artificial Sequence
  CD80 v320 IgV
VIHVTKEVKEVATLSCGHNVSVEELAQTRIYWQKDKKMVLTMMSGDINIWPEYKNRTIFDISNNLSIVILALRPSDEGTYECVVQKYDKDAFKREHLAEVTLSVKAD

SEQ ID NO: 2748 - protein, 107 aa, Artificial Sequence
  CD80 v321 IgV
VIHVTKEVKEVATLSCGHNVSVEDLARTRIYWQKDKKMVLSMMSGDVNIWPEYKNRTIFDITNNLSIVILALRPSDEGTYECVVQKYEKDAFKREHLAEVTLSVKAD

SEQ ID NO: 2749 - protein, 107 aa, Artificial Sequence
  CD80 v322 IgV
VIHVTKEVKEVATLTCGYNVSVEELAQTRIYWQKDKKMVLTMMSGDVNIWPEYKNRTIFDIANSLSIVILGLRPSDEGTYECVVQKYEKNAFKREHLAEVTLSVKAD

SEQ ID NO: 2750 - protein, 107 aa, Artificial Sequence
  CD80 v323 IgV
VIHVTKEVKEVATLSCGHNVSVEELAQTRIYWQKDKKMVLTMMSGDLNIWPEYKNRTIFDITNNLSIMILGLRPSDEGTYECVVQKYEKGAFKREHLAEVTLSVKAD

SEQ ID NO: 2751 - protein, 107 aa, Artificial Sequence
  CD80 v324 IgV
VIHVTKEVKEVATLSCGYNVSVEELAQTRIYWQKDKKMVLTMMSGDINIWPEYKNRTIFDITNNLSIMILGLRPSDEGTYECVVLKYEKDAFKLEHLAEVTLSVKAD

SEQ ID NO: 2752 - protein, 18 aa, Artificial Sequence
  CD80 v325 IgV
VIHVTKEVKEVTLSVKAD

SEQ ID NO: 2753 - protein, 107 aa, Artificial Sequence
  CD80 v326 IgV
VIHVTKEVKEVATLSCGHNVSVEELAQTRIYWRKEKKMVLTMMSGDVNIWPEYKNRTIFDINNNLSIVILGLRPSDEGTYECVVLKYEKDAFKREHLAEVTLSVKAD

SEQ ID NO: 2754 - protein, 107 aa, Artificial Sequence
  CD80 v327 IgV
VIHVTKEVKEVATLSCGYNVSAEELAQTRIYWQKDKKMVLSMMSGDVNIWPEYKNRTIFDINNNLSIVILGLRPSDEGTYECVVLKYEKDGFKREHLAEVTLSVKAD

SEQ ID NO: 2755 - protein, 107 aa, Artificial Sequence
  CD80 v328 IgV
VIHVTKEVKEVATLSCGHNVSVEELAQTRIYWQKDKKMVLTMMSGDLNIWPEYKNRTIFDITNNLSIVIMALRPSDEGTYECVVLKYEKDAFKREHLAEVTLSVKAD

SEQ ID NO: 2756 - protein, 107 aa, Artificial Sequence
  CD80 v329 IgV
VIHVTKEVKEVATLSCGHNVSVEELAQTRIYWQKDKKMVLTMMSGDLNIWPEYKNRTIFDITNNLSIMILALRPSDEGTYECVVLKYEKDAFKREHLAEVTLSVKAD

SEQ ID NO: 2757 - protein, 107 aa, Artificial Sequence
  CD80 v330 IgV
VIHVTKEVKEVATLSCGHNVSVEELAQTRIYWQKDKKMVLTMMSGVLNIWPEYKNRTIFDITNNLSIMILALRPSDEGTYECVVLKYDKDAFKREHLAEVTLSVKAD

SEQ ID NO: 2758 - protein, 107 aa, Artificial Sequence
  CD80 v331 IgV
VIHVTKEVKEVATLSCGHNVSVEELAQTRIYWQKDKKMVLTMMSGVLNIWPEYKNRTIFDITNNLSIMILALRPSDEGTYECVVLKYEKGAFKREHLAEVTLSVKAD

SEQ ID NO: 2759 - protein, 107 aa, Artificial Sequence
  CD80 v332 IgV
VIHVTKEVKEVATLSCGHNVSVEELAQTRIYWQKDKKMVLTMMSGVLNIWPEYKNRTIFDITNNLSIMILALRPSDEGTYECVVLKYENDAFKREHLAEVTLSVKAD

SEQ ID NO: 2760 - protein, 107 aa, Artificial Sequence
  CD80 v333 IgV
VIHVTKEVKEVATLSCGHNVSVEELAQTRIYWQKDKKMVLTMMSGVLNIWPEYKNRTIFDITNNLSIMILALRPSDEGTYECVVQKYEKDAFKREHLAEVTLSVKAD

SEQ ID NO: 2761 - protein, 107 aa, Artificial Sequence
  CD80 v334 IgV
VIHVTKEVKEVATLSCGHNVSVEELAQTRIYWQKDKKMVLTMMSGVLNIWPEYKNRTIFDITNNLSIMILALRPSDEGTYECVVLKYEKDAFKREHLAEVTLSVKAD

SEQ ID NO: 2762 - protein, 107 aa, Artificial Sequence
  CD80 v335 IgV
VIHVTKEVKEVATLSCGHNVSVEELAQTRIYWQKDKKMVLTMMSGVLNIWPEYKNRTIFDITNNLSIVIMALRPSDEGTYECVVLKYEKDAFKREHLAEVTLSVKAD

SEQ ID NO: 2763 - protein, 107 aa, Artificial Sequence
  CD80 v336 IgV
VIHVTKEVKEVATLSCGHNVSVEELAQTRIYWQKDKKMVLTMMSGVLNIWPEYKNRTIFDITNNLSIVIMALRPSDEGTYECVVQKYEKDAFKREHLAEVTLSVKAD

SEQ ID NO: 2764 - protein, 107 aa, Artificial Sequence
  CD80 v337 IgV
VIHVTKEVKEVATLSCGHNVSVEELAQTRIYWQKDKKMVLTMMSGDVKIWPEYKNRTIFDITNNLSIMILALRPSDEGTYECVVLKYEKDAFKREHLAEVTLSVKAD

SEQ ID NO: 2765 - protein, 107 aa, Artificial Sequence
  CD80 v338 IgV
VIHVTKEVKEVATLSCGHNVSVEDLAQTRIYWQKDKKMVLTMMSGDLNIWPEYKNRTIFDITNNLSIMILALRPSDEGTYECVVLKYEKDAFKRVHQAEVTLSVKAD

SEQ ID NO: 2766 - protein, 107 aa, Artificial Sequence
  CD80 v339 IgV
VIHVTKEVKEVATLSCGHNVSVEELAQTRIYWQKDKKMVLTMMSGEINIWPEYKNRTIFDIANNLSIMILALRPSDEGTYECVVMKCEKDAFKREHLAEVTLSVKAD

SEQ ID NO: 2767 - protein, 107 aa, Artificial Sequence
  CD80 v340 IgV
VIHVTKEVKEVATLSCGHNVSVEELAQTRIYWQKDKKMVLTMMSGEINIWPEYKNRTIFDITNNLSIMILALRPSDEGTYECVVMKYEKDAFKREHLAEVTLSVKAD

SEQ ID NO: 2768 - protein, 107 aa, Artificial Sequence
  CD80 v341 IgV
VIHVTKEVKEVATLSCGHNVSVEELAQTRIYWQKDKKMVLTMMSGELNIWPEYKNRTIFDITNNLSIMILGLRPSDEGTYECVVLKCEKDAFRREHLAEVTLSVKAD

SEQ ID NO: 2769 - protein, 107 aa, Artificial Sequence
  CD80 v342 IgV
VIHVTKEVKEVATLSCGHNVSVEELAQTRIYWQKDKKMVLTMMSGELNIWPEYKNRTIFDITNNLSIMILALRPSDEGMYECVVMKYEKDAFKREHLAEVTLSVKAD

SEQ ID NO: 2770 - protein, 107 aa, Artificial Sequence
  CD80 v343 IgV
VIHVTKEVKEVATLSCGHNVSVEELAQTRIYWQKDKKMVLTMMSGELNIWPEYKNRTIFDITNNLSIMILALRPSDEGMYECVVMKYEKDAFKREHQAEVTLSVKAD

SEQ ID NO: 2771 - protein, 107 aa, Artificial Sequence
  CD80 v344 IgV
VIHVTKEVKEVATLSCGHNVSVEELAQTRIYWQKDKKMVLTMMSGEVNIWPEYKNRTIFDITNNLSIMILALRPSDEGTYECVVQKYEKDAFKREHLAEVTLSVKAD

SEQ ID NO: 2772 - protein, 107 aa, Artificial Sequence
  CD80 v345 IgV
VIHVTKEVKEVATLSCGHNVSVEELAQTRIYWQKDKKMVLTMISGDLNIWPEYKNRTIFDITNNLSIMILALRPSDEGTYECVVLKYEKDAFKREHLAEVTLSVKAD

SEQ ID NO: 2773 - protein, 107 aa, Artificial Sequence
  CD80 v346 IgV
VIHVTKEVKEVATLSCGHNVSVEELAQTRIYWQKDKKMVLTMMSGDINIWPEYKNRTIFDITNNLSIMILALRPSDEGTYECVVLKNEKDAFKREHLAEVTLSVKAD

SEQ ID NO: 2774 - protein, 107 aa, Artificial Sequence
  CD80 v347 IgV
VIHVTKEVKEVATLSCGHNVSVEELAQTRIYWQKDKKMVLTMMSGDLNIWPEYKNRTIFDITNNLSIMILALRPSDEGTYECVVLKYEKDAFKRVHQAEVTLSVKAD

SEQ ID NO: 2775 - protein, 107 aa, Artificial Sequence
  CD80 v348 IgV
VIHVTKEVKEVATLSCGHNVSVEELAQTRIYWQKDKKMVLTMMSGDLNIWPEFKNRTIFDITNNLSIMILGLRPSDEGTYECVVLKYEKDAFRRVHLAEVTLSVKAD

SEQ ID NO: 2776 - protein, 107 aa, Artificial Sequence
  CD80 v349 IgV
VIHVTKEVKEVATLSCGHNVSVEELAQTRIYWQKDKKMVLTMMSGDVKIWPEYKNRTIFDITNNLSIMILGLRPSDEGTYECVVMKYEKDAFKREHLAEVTLSVKAD

SEQ ID NO: 2777 - protein, 107 aa, Artificial Sequence
  CD80 v350 IgV
VIHVTKEVKEVATLSCGHNVSVEELAQTRIYWQKDKKMVLTMMSGDVKIWPEYKNRTIFDITNNLSIMILALRPSDEGTYECVVMKYEKDAFKREHLAEVTLSVKAD

SEQ ID NO: 2778 - protein, 107 aa, Artificial Sequence
  CD80 v351 IgV
VIHVTKEVKEVATLSCGHNVSVEELAQTRIYWQKDKKMVLTMMSGDVNIWPEYKNRTIFDITNNLSIMILALRPSDEGTYECVVMKYEKDAFKREHLAEVTLSVKAD

SEQ ID NO: 2779 - protein, 107 aa, Artificial Sequence
  CD80 v352 IgV
VIHVTKEVKEVATLSCGHNVSVEELAQTRIYWQKDKKMVLTMMSGDVNIWPEYKNRTIFDITNNLSIMILALRPSDEGTYECVVMKDEKDAFKREHLAEVTLSVKAD

SEQ ID NO: 2780 - protein, 107 aa, Artificial Sequence
  CD80 v353 IgV
VIHVTKEVKEVATLSCGHNVSVEELAQTRIYWQKDKKMVLSMMSGEINIWPEYKNRTIFDITNNLSIMILALRPSDEGTYECVVLKYEKDAFRRVHLAEVTLSVKAD

SEQ ID NO: 2781 - protein, 107 aa, Artificial Sequence
  CD80 v354 IgV
VIHVTKEVKEVATLSCGYNVSVEELAQTRIYWQKDKKMVLTMMSGEINIWPEYKNRTIFDITNNLSIMILALRPSDEGTYECVVLKYEKDAFKLEHLAEVTLSVKAD

SEQ ID NO: 2782 - protein, 107 aa, Artificial Sequence
  CD80 v355 IgV
VIHVTKEVKEVATLSCGYNVSVEELAQTRIYWQKDKKIVLTMMSGDLNIWPEYKNRTIFDITNNLSIMILALRPSDEGTYECVVMKYEKDAFKREHLAEVTLSVKAD

SEQ ID NO: 2783 - protein, 107 aa, Artificial Sequence
  CD80 v356 IgV
VIHVTKEVKEVATLSCGYNVSVEELAQTRIYWQKDKKMVLTMMSGDINIWPEYKNRTIFDITNNLSIMILALRPSDEGTYECVVLKNEKDAFKREHLAEVTLSVKAD

SEQ ID NO: 2784 - protein, 107 aa, Artificial Sequence
  CD80 v357 IgV
VIHVTKEVKEVATLSCGYNVSVEELAQTRIYWQKDKKMVLTMMSGDLNIWPEYKNRTIFDITNNLSIMILGLRPSDEGTYECVVMKYEKDAFKREHLAEVTLSVKAD

SEQ ID NO: 2785 - protein, 107 aa, Artificial Sequence
  CD80 v358 IgV
VIHVTKEVKEVATLSCGYNVSVEELAQTRIYWQKDKKMVLTMMSGDLNIWPEYKNRTIFDITNNLSIMILALRPSDEGTYECVVLKYEKDAFKRVHQAEVTLSVKAD

SEQ ID NO: 2786 - protein, 107 aa, Artificial Sequence
  CD80 v359 IgV
VIHVTKEVKEVATLSCGYNVSVEELAQTRIYWQKDKKMVLTMMSGDLNIWPEFKNRTIFDITNNLSIMILGLRPSDEGTYECVVLKYEKDAFKREHLAEVTLSVKAD

SEQ ID NO: 2787 - protein, 107 aa, Artificial Sequence
  CD80 v360 IgV
VIHVTKEVKEVATLSCGYNVSVEELAQTRIYWQKDKKMVLTMMSGDLNIWPEFKNRTIFDITNNLSIMILGLRPSDEGTYECVVLKYEKDAFRRVHLAEVTLSVKAD

SEQ ID NO: 2788 - protein, 107 aa, Artificial Sequence
  CD80 v361 IgV
VIHVTKEVKEVATLSCGYNVSVEELAQTRIYWQKDKKMVLTMMSGDVNIWPEYKNRTIFDITNNLSIMILALRPSDEGTYECVVMKYEKDAFKREHLAEVTLSVKAD

SEQ ID NO: 2789 - protein, 107 aa, Artificial Sequence
  CD80 v362 IgV
VIHVTKEVKEVATLSCGYNVSVEELAQTRIYWQKDKKMVLTMMSGDMNIWPEYKNRTIFDITNNLSIMILGLRPSDEGTYECVVLKYEKDAFKQVHLAEVTLSVKAD

SEQ ID NO: 2790 - protein, 107 aa, Artificial Sequence
  CD80 v363 IgV
VIHVTKEVKEVATLSCGYNVSVEELAQTRIYWQKDKKMVLTMMSGDMNIWPEYKNRTIFDITNNLSIMILALRPSDEGTYECVVMKYEKDAFKQEHLAEVTLSVKAD

SEQ ID NO: 2791 - protein, 107 aa, Artificial Sequence
  CD80 v364 IgV
VIHVTKEVKEVATLSCGYNVSVEELAQTRIYWQKDKKMVLTMMSGDMNIWPEYKNRTIFDITNNLSIMILALRPSDEGMYECVVMKYEKDAFKREHLAEVTLSVKAD

SEQ ID NO: 2792 - protein, 107 aa, Artificial Sequence
  CD80 v365 IgV
VIHVTKEVKEVATLSCGYNVSDEELAQTRIYWQKDKKMVLTMMSGDVKIWPEYKNRTIFDITNNLSIMILALRPSDEGTYECVVLKYEKDAFKREHLAEVTLSVKAD

SEQ ID NO: 2793 - protein, 107 aa, Artificial Sequence
  CD80 v366 IgV
VIHVTKEVKEVATLSCGHNVSVEELALTRIYWLKDKKMVLSMMSGDVKIWPEYKNRTIFDITNNLSIMILALRPSDEGTYECVVMKYEKDAFKREHLAEVTLSVKAD

SEQ ID NO: 2794 - protein, 107 aa, Artificial Sequence
  CD80 v367 IgV
VIHVTKEVKEVATLSCGHNVSVEELAQTRIYWLKDKKMVLTMMSGDVNIWPEYKNRTIFDISNNLSIMILALRPSDEGTYECVVMKYEKDAFKREHLAEVTLSVKAD

SEQ ID NO: 2795 - protein, 107 aa, Artificial Sequence
  CD80 v368 IgV
VIHVTKEVKEVATLSCGHNVSVEELAQTRIYWRKDKKIVLTMMSGDLNIWPEYKNRTIFDITNNLSIMILALRPSDEGTYECVVLKYEKDAFKREHLAEVTLSVKAD

SEQ ID NO: 2796 - protein, 107 aa, Artificial Sequence
  CD80 v369 IgV
VIHVTKEVKEVATLSCGHNVSVEELAQTCIYWQKDKKMVLTMMSGDLNIWPEYKNRTIFDITNNLSIMILGLRPSDEGTYECVVMKYEKDAFKREHLAEVTLSVKAD

SEQ ID NO: 2797 - protein, 107 aa, Artificial Sequence
  CD80 v370 IgV
VIHVTKEVKEVATLSCGHNVPVEELAQTRIYWQKDKEMVLTMMSGEINIWPEYKNRTIFDITNNLSIMILALRPSDEGTYECVVLKYEKDAFKREHLAEVTLSVKAD

SEQ ID NO: 2798 - protein, 107 aa, Artificial Sequence
  CD80 v371 IgV
VIHVTKEVKEVATLSCGHNVPVEELAQTRIYWQKDKEMVLTMMSGEINIWPEYKNRTIFDITNNLSIMILALRPSDEGTYECVVLKYEKDAFKLEHLAEVTLSVKAD

SEQ ID NO: 2799 - protein, 107 aa, Artificial Sequence
  CD80 v372 IgV
VIHVTKEVKEVARLSCGHNVSVEELAQTRIYWQKDKKMVLTMMSGDLNIWPEYKNRTIFDITNNLSIMILALRPSDEGTYECVVLKYEKDAFKREHLAEVTLSVKAD

SEQ ID NO: 2800 - protein, 107 aa, Artificial Sequence
  CD80 v373 IgV
VIHVTKEVKEVARLSCGYNVSVEELAQTRIYWQKDKKMVLTMMSGDMNIWPEYKNRTIFDITNNLSIMILALRPSDEGTYECVVMKYEKDAFKQEHLAEVTLSVKAD

SEQ ID NO: 2801 - protein, 107 aa, Artificial Sequence
  CD80 v374 IgV
VIHVTKEVKEVARLSCGHNVSVEELALTRIYWLKDKKMVLSMMSGDVKIWPEYKNRTIFDITNNLSIMILALRPSDEGTYECVVMKYEKDAFKREHLAEVTLSVKAD

SEQ ID NO: 2802 - protein, 107 aa, Artificial Sequence
  CD80 v375 IgV
VIHVTKEVKEVARLSCGHNVSVEELAQTRIYWLKDKKMVLTMMSGDLNIWPEYKNRTIFDITNNLSIMILALRPSDEGTYECVVMKYEKDAFKREHLAEVTLSVKAD

SEQ ID NO: 2803 - protein, 107 aa, Artificial Sequence
  CD80 v376 IgV
VIHVTKEVKEVARLSCGHNVSVEELAQTRIYWLKDKKMVLTMMSGDVNIWPEYKNRTIFDISNNLSIMILALRPSDEGTYECVVMKYEKDAFKREHLAEVTLSVKAD

SEQ ID NO: 2804 - protein, 107 aa, Artificial Sequence
  CD80 v377 IgV
VIHVTKEVKEVARLSCGHNVSVEELAQTRIYWRKDKKIVLTMMSGDLNIWPEYKNRTIFDITNNLSIMILALRPSDEGTYECVVLKYEKDAFKREHLAEVTLSVKAD

SEQ ID NO: 2805 - protein, 107 aa, Artificial Sequence
  CD80 v378 IgV
VIHVTKEVKEVARLSCGHNVSVEELAQTRIYWRKDKKIVLTMMSGDLNIWPEYKNRTIFDITNNLSIMILALRPSDEGTYECVVLKYEKDAFKRVHQAEVTLSVKAD

SEQ ID NO: 2806 - protein, 107 aa, Artificial Sequence
  CD80 v379 IgV
VIHVTKEVKEVARLSCGHNVSVEELAQTRIYWRKDKKIVLTMMSGDLNIWPEYKNRTIFDITNNLSIMILALRPSDEGTYECVVMKYEKDAFKREHLAEVTLSVKAD

SEQ ID NO: 2807 - protein, 107 aa, Artificial Sequence
  CD80 v380 IgV
VIHVTKEVKEVARLSCGHNVSVEELAQTRIYWRKDKKIVLTMMSGDLNIWPEYKNRTIFDITNNLSIMILALRPSDEGTYECVVMKYEKDAFKQEHLAEVTLSVKAD

SEQ ID NO: 2808 - protein, 107 aa, Artificial Sequence
  CD80 v381 IgV
VIHVTKEVKEVARLSCGHNVSVEELAQTRIYWRKDKKMVLTMMSGDLNIWPEYKNRTIFDITNNLSIMILALRPSDEGTYECVVLKYEKDAFKREHLAEVTLSVKAD

SEQ ID NO: 2809 - protein, 107 aa, Artificial Sequence
  CD80 v382 IgV
VIHVTKEVKEVARLSCGHNVSVEELAQTRIYWRKDKKMVLTMMSGDLNIWPEYKNRTIFDITNNLSIMILALRPSDEGTYECVVMKYEKDAFKREHLAEVTLSVKAD

SEQ ID NO: 2810 - protein, 107 aa, Artificial Sequence
  CD80 v383 IgV
VIHVTKEVKEVATLSCGHNVSDEDLAQTRIYWQKDKKMVLTMMSGDLNIWPEYKNRTIFDITNNLSIMILALRPSDEGTYECVVLKYEKDAFKREHLAEVTLSVKAD

SEQ ID NO: 2811 - protein, 107 aa, Artificial Sequence
  CD80 v384 IgV
VIHVTKEVKEVATLSCGHNVSDEDLAQTRIYWQKDKKMVLTMMSGDLNIWPEYKNRTIFDITNNLSIMILALRPSDEGTYECVVMKYEKGAFKREHLAEVTLSVKAD

SEQ ID NO: 2812 - protein, 107 aa, Artificial Sequence
  CD80 v385 IgV
VIHVTKEVKEVATLSCGHNVSDEDLAQTRIYWQKDKKMVLTMMSGDVNIWPEYKNRTIFDITNNLSIMILALRPSDEGTYECVVLKYEKDAFKREHLAEVTLSVKAD

SEQ ID NO: 2813 - protein, 107 aa, Artificial Sequence
  CD80 v386 IgV
VIHVTKEVKEVATLSCGHNVSVEELAQTRIYWQKEKKMVLTMMSGVMNIWPEYKNRTIFDITNNLSIVILALRPSDEGTYECVVLKYEKDAFKREHLAEVTLSVKAD

SEQ ID NO: 2814 - protein, 107 aa, Artificial Sequence
  CD80 v387 IgV
VIHVTKEVKEVATLSCGHNVSVEELAQTRIYWQKEKKMVLTMMSGDLNIWPEYKNRTIFDITNNLSIVILALRPSDEGTYECVVLKYEKDAFKREHLAEVTLSVKAD

SEQ ID NO: 2815 - protein, 107 aa, Artificial Sequence
  CD80 v388 IgV
VIHVTKEVKEVATLSCGHNVSVEELAQTRIYWQKEKKMVLTMMSGDMNIWPEYKNRTIFDITNNLSIMILALRPSDEGTYECVVLKYEKDAFKREHLAEVTLSVKAD

SEQ ID NO: 2816 - protein, 107 aa, Artificial Sequence
  CD80 v389 IgV
VIHVTKEVKEVATLSCGHNVSVEELAQTRIYWQKEKKMVLTMMSGDMNIWPEYKNRTIFDITNNLSIVILALRPSDEGTYECVVQKYEKDAFKREHLAEVTLSVKAD

SEQ ID NO: 2817 - protein, 107 aa, Artificial Sequence
  CD80 v390 IgV
VIHVTKEVKEVATLSCGHNVSVEELAQTRIYWQKDKKMVLTMMSGVMNIWPEYKNRTIFDITNNLSIVILALRPSDEGTYECVVLKYEKDAFKREHLAEVTLSVKAD

SEQ ID NO: 2818 - protein, 107 aa, Artificial Sequence
  CD80 v392 IgV
VIHVTKEVKEVATLSCGHNVSVEELAQTRIYWQKDKKMVLTMMSGDMNIWPEYKNRTIFDITNNLSIMILALRPSDEGTYECVVLKYEKDAFKREHLAEVTLSVKAD

SEQ ID NO: 2819 - protein, 107 aa, Artificial Sequence
  CD80 v393 IgV
VIHVTKEVKEVATLSCGHNVSVEELAQTRIYWQKDKKMVLTMMSGDMNIWPEYKNRTIFDITNNLSIVILALRPSDEGTYECVVQKYEKDAFKREHLAEVTLSVKAD

SEQ ID NO: 2820 - protein, 107 aa, Artificial Sequence
  CD80 v394 IgV
VIHVTKEVKEVATLSCGHNVSVEELAQTRIYWQKEKKMVLTMMSGVLNIWPEYKNRTIFDITNNLSIVILALRPSDEGTYECVVLKYEKDAFKREHLAEVTLSVKAD

SEQ ID NO: 2821 - protein, 107 aa, Artificial Sequence
  CD80 v395 IgV
VIHVTKEVKEVATLSCGHNVSVEELAQTRIYWQKEKKMVLTMMSGVMNIWPEYKNRTIFDITNNLSIMILALRPSDEGTYECVVLKYEKDAFKREHLAEVTLSVKAD

SEQ ID NO: 2822 - protein, 107 aa, Artificial Sequence
  CD80 v396 IgV
VIHVTKEVKEVATLSCGHNVSVEELAQTRIYWQKEKKMVLTMMSGVMNIWPEYKNRTIFDITNNLSIVILALRPSDEGTYECVVQKYEKDAFKREHLAEVTLSVKAD

SEQ ID NO: 2823 - protein, 107 aa, Artificial Sequence
  CD80 v397 IgV
VIHVTKEVKEVATLSCGHNVSVEELAQTRIYWQKEKKMVLTMMSGDLNIWPEYKNRTIFDITNNLSIMILALRPSDEGTYECVVLKYEKDAFKREHLAEVTLSVKAD

SEQ ID NO: 2824 - protein, 107 aa, Artificial Sequence
  CD80 v398 IgV
VIHVTKEVKEVATLSCGHNVSVEELAQTRIYWQKEKKMVLTMMSGDLNIWPEYKNRTIFDITNNLSIVILALRPSDEGTYECVVQKYEKDAFKREHLAEVTLSVKAD

SEQ ID NO: 2825 - protein, 107 aa, Artificial Sequence
  CD80 v399 IgV
VIHVTKEVKEVATLSCGHNVSVEELAQTRIYWQKEKKMVLTMMSGDMNIWPEYKNRTIFDITNNLSIMILALRPSDEGTYECVVQKYEKDAFKREHLAEVTLSVKAD

SEQ ID NO: 2826 - protein, 107 aa, Artificial Sequence
  CD80 v400 IgV
VIHVTKEVKEVATLSCGHNVSVEELAQTRIYWQKDKKMVLTMMSGVLNIWPEYKNRTIFDITNNLSIVILALRPSDEGTYECVVLKYEKDAFKREHLAEVTLSVKAD

SEQ ID NO: 2827 - protein, 107 aa, Artificial Sequence
  CD80 v401 IgV
VIHVTKEVKEVATLSCGHNVSVEELAQTRIYWQKDKKMVLTMMSGVMNIWPEYKNRTIFDITNNLSIMILALRPSDEGTYECVVLKYEKDAFKREHLAEVTLSVKAD

SEQ ID NO: 2828 - protein, 107 aa, Artificial Sequence; identical to SEQ ID NO: 203
  CD80 v402 IgV

SEQ ID NO: 2829 - protein, 107 aa, Artificial Sequence
  CD80 v403 IgV
VIHVTKEVKEVATLSCGHNVSVEELAQTRIYWQKDKKMVLTMMSGDMNIWPEYKNRTIFDITNNLSIMILALRPSDEGTYECVVQKYEKDAFKREHLAEVTLSVKAD

SEQ ID NO: 2830 - protein, 107 aa, Artificial Sequence
  CD80 v404 IgV
VIHVTKEVKEVATLSCGHNVSVEELAQTRIYWQKEKKMVLTMMSGVLNIWPEYKNRTIFDITNNLSIMILALRPSDEGTYECVVLKYEKDAFKREHLAEVTLSVKAD

SEQ ID NO: 2831 - protein, 107 aa, Artificial Sequence
  CD80 v405 IgV
VIHVTKEVKEVATLSCGHNVSVEELAQTRIYWQKEKKMVLTMMSGVLNIWPEYKNRTIFDITNNLSIVILALRPSDEGTYECVVQKYEKDAFKREHLAEVTLSVKAD

SEQ ID NO: 2832 - protein, 107 aa, Artificial Sequence
  CD80 v406 IgV
VIHVTKEVKEVATLSCGHNVSVEELAQTRIYWQKEKKMVLTMMSGVMNIWPEYKNRTIFDITNNLSIMILALRPSDEGTYECVVQKYEKDAFKREHLAEVTLSVKAD

SEQ ID NO: 2833 - protein, 107 aa, Artificial Sequence
  CD80 v407 IgV
VIHVTKEVKEVATLSCGHNVSVEELAQTRIYWQKEKKMVLTMMSGDLNIWPEYKNRTIFDITNNLSIMILALRPSDEGTYECVVQKYEKDAFKREHLAEVTLSVKAD

SEQ ID NO: 2834 - protein, 107 aa, Artificial Sequence
  CD80 v408 IgV
VIHVTKEVKEVATLSCGHNVSVEELAQTRIYWQKDKKMVLTMMSGVLNIWPEYKNRTIFDITNNLSIVILALRPSDEGTYECVVQKYEKDAFKREHLAEVTLSVKAD

SEQ ID NO: 2835 - protein, 107 aa, Artificial Sequence
  CD80 v409 IgV
VIHVTKEVKEVATLSCGHNVSVEELAQTRIYWQKDKKMVLTMMSGVMNIWPEYKNRTIFDITNNLSIMILALRPSDEGTYECVVQKYEKDAFKREHLAEVTLSVKAD

SEQ ID NO: 2836 - protein, 107 aa, Artificial Sequence
  CD80 v410 IgV
VIHVTKEVKEVATLSCGHNVSVEELAQTRIYWQKDKKMVLTMMSGDLNIWPEYKNRTIFDITNNLSIMILALRPSDEGTYECVVQKYEKDAFKREHLAEVTLSVKAD

SEQ ID NO: 2837 - protein, 107 aa, Artificial Sequence
  CD80 v411 IgV
VIHVTKEVKEVATLSCGHNVSVEELAQTRIYWQKEKKMVLTMMSGVLNIWPEYKNRTIFDITNNLSIMILALRPSDEGTYECVVQKYEKDAFKREHLAEVTLSVKAD

SEQ ID NO: 2838 - protein, 107 aa, Artificial Sequence
  CD80 v412 IgV
VIHVTKEVKEVATLSCGHNVSVEELAQTRIYWQKEKKMVLTMMSGDVNIWPEYKNRTIFDITNNLSIVILALRPSDEGTYECVVLKYEKDAFKREHLAEVTLSVKAD

SEQ ID NO: 2839 - protein, 107 aa, Artificial Sequence
  CD80 v413 IgV
VIHVTKEVKEVATLSCGHNVSVEELAQTRIYWQKEKKMVLTMMSGDMKIWPEYKNRTIFDITNNLSIVILALRPSDEGTYECVVLKYEKDAFKREHLAEVTLSVKAD

SEQ ID NO: 2840 - protein, 107 aa, Artificial Sequence
  CD80 v414 IgV
VIHVTKEVKEVATLSCGHNVSVEELAQTRIYWQKEKKMVLTMMSGDMNIWPEYKNRTIFDITNNLSIVILALRPSDEGTYECVVLKYENDAFKREHLAEVTLSVKAD

SEQ ID NO: 2841 - protein, 107 aa, Artificial Sequence
  CD80 v415 IgV
VIHVTKEVKEVATLSCGHNVSVEELAQTRIYWQKDKKMVLTMMSGDMKIWPEYKNRTIFDITNNLSIVILALRPSDEGTYECVVLKYEKDAFKREHLAEVTLSVKAD

SEQ ID NO: 2842 - protein, 107 aa, Artificial Sequence
  CD80 v416 IgV
VIHVTKEVKEVATLSCGHNVSVEELAQTRIYWQKDKKMVLTMMSGDMNIWPEYKNRTIFDITNNLSIVILALRPSDEGTYECVVLKYENDAFKREHLAEVTLSVKAD

SEQ ID NO: 2843 - protein, 107 aa, Artificial Sequence
  CD80 v417 IgV
VIHVTKEVKEVATLSCGHNVSVEELAQTRIYWQKEKKMVLTMMSGDVKIWPEYKNRTIFDITNNLSIVILALRPSDEGTYECVVLKYEKDAFKREHLAEVTLSVKAD

SEQ ID NO: 2844 - protein, 107 aa, Artificial Sequence
  CD80 v418 IgV
VIHVTKEVKEVATLSCGHNVSVEELAQTRIYWQKEKKMVLTMMSGDVNIWPEYKNRTIFDITNNLSIMILALRPSDEGTYECVVLKYEKDAFKREHLAEVTLSVKAD

SEQ ID NO: 2845 - protein, 107 aa, Artificial Sequence
  CD80 v419 IgV
VIHVTKEVKEVATLSCGHNVSVEELAQTRIYWQKEKKMVLTMMSGDVNIWPEYKNRTIFDITNNLSIVILALRPSDEGTYECVVLKYENDAFKREHLAEVTLSVKAD

SEQ ID NO: 2846 - protein, 107 aa, Artificial Sequence
  CD80 v420 IgV
VIHVTKEVKEVATLSCGHNVSVEELAQTRIYWQKEKKMVLTMMSGDMKIWPEYKNRTIFDITNNLSIMILALRPSDEGTYECVVLKYEKDAFKREHLAEVTLSVKAD

SEQ ID NO: 2847 - protein, 107 aa, Artificial Sequence
  CD80 v421 IgV
VIHVTKEVKEVATLSCGHNVSVEELAQTRIYWQKEKKMVLTMMSGDMKIWPEYKNRTIFDITNNLSIVILALRPSDEGTYECVVLKYENDAFKREHLAEVTLSVKAD

SEQ ID NO: 2848 - protein, 107 aa, Artificial Sequence
  CD80 v422 IgV
VIHVTKEVKEVATLSCGHNVSVEELAQTRIYWQKEKKMVLTMMSGDMNIWPEYKNRTIFDITNNLSIMILALRPSDEGTYECVVLKYENDAFKREHLAEVTLSVKAD

SEQ ID NO: 2849 - protein, 107 aa, Artificial Sequence
  CD80 v423 IgV
VIHVTKEVKEVATLSCGHNVSVEELAQTRIYWQKDKKMVLTMMSGDVKIWPEYKNRTIFDITNNLSIVILALRPSDEGTYECVVLKYEKDAFKREHLAEVTLSVKAD

SEQ ID NO: 2850 - protein, 107 aa, Artificial Sequence
  CD80 v424 IgV
VIHVTKEVKEVATLSCGHNVSVEELAQTRIYWQKDKKMVLTMMSGDVNIWPEYKNRTIFDITNNLSIMILALRPSDEGTYECVVLKYEKDAFKREHLAEVTLSVKAD

SEQ ID NO: 2851 - protein, 107 aa, Artificial Sequence
  CD80 v425 IgV
VIHVTKEVKEVATLSCGHNVSVEELAQTRIYWQKDKKMVLTMMSGDVNIWPEYKNRTIFDITNNLSIVILALRPSDEGTYECVVLKYENDAFKREHLAEVTLSVKAD

SEQ ID NO: 2852 - protein, 107 aa, Artificial Sequence
  CD80 v426 IgV
VIHVTKEVKEVATLSCGHNVSVEELAQTRIYWQKDKKMVLTMMSGDMKIWPEYKNRTIFDITNNLSIMILALRPSDEGTYECVVLKYEKDAFKREHLAEVTLSVKAD

SEQ ID NO: 2853 - protein, 107 aa, Artificial Sequence
  CD80 v427 IgV
VIHVTKEVKEVATLSCGHNVSVEELAQTRIYWQKDKKMVLTMMSGDMKIWPEYKNRTIFDITNNLSIVILALRPSDEGTYECVVLKYENDAFKREHLAEVTLSVKAD

SEQ ID NO: 2854 - protein, 107 aa, Artificial Sequence
  CD80 v428 IgV
VIHVTKEVKEVATLSCGHNVSVEELAQTRIYWQKDKKMVLTMMSGDMNIWPEYKNRTIFDITNNLSIMILALRPSDEGTYECVVLKYENDAFKREHLAEVTLSVKAD

SEQ ID NO: 2855 - protein, 107 aa, Artificial Sequence
  CD80 v429 IgV
VIHVTKEVKEVATLSCGHNVSVEELAQTRIYWQKEKKMVLTMMSGDVKIWPEYKNRTIFDITNNLSIMILALRPSDEGTYECVVLKYEKDAFKREHLAEVTLSVKAD

SEQ ID NO: 2856 - protein, 107 aa, Artificial Sequence
  CD80 v430 IgV
VIHVTKEVKEVATLSCGHNVSVEELAQTRIYWQKEKKMVLTMMSGDVKIWPEYKNRTIFDITNNLSIVILALRPSDEGTYECVVLKYENDAFKREHLAEVTLSVKAD

SEQ ID NO: 2857 - protein, 107 aa, Artificial Sequence
  CD80 v431 IgV
VIHVTKEVKEVATLSCGHNVSVEELAQTRIYWQKEKKMVLTMMSGDVNIWPEYKNRTIFDITNNLSIMILALRPSDEGTYECVVLKYENDAFKREHLAEVTLSVKAD

SEQ ID NO: 2858 - protein, 107 aa, Artificial Sequence
  CD80 v432 IgV
VIHVTKEVKEVATLSCGHNVSVEELAQTRIYWQKEKKMVLTMMSGDMKIWPEYKNRTIFDITNNLSIMILALRPSDEGTYECVVLKYENDAFKREHLAEVTLSVKAD

SEQ ID NO: 2859 - protein, 107 aa, Artificial Sequence
  CD80 v433 IgV
VIHVTKEVKEVATLSCGHNVSVEELAQTRIYWQKDKKMVLTMMSGDVKIWPEYKNRTIFDITNNLSIVILALRPSDEGTYECVVLKYENDAFKREHLAEVTLSVKAD

SEQ ID NO: 2860 - protein, 107 aa, Artificial Sequence
  CD80 v434 IgV
VIHVTKEVKEVATLSCGHNVSVEELAQTRIYWQKDKKMVLTMMSGDVNIWPEYKNRTIFDITNNLSIMILALRPSDEGTYECVVLKYENDAFKREHLAEVTLSVKAD

SEQ ID NO: 2861 - protein, 107 aa, Artificial Sequence
  CD80 v435 IgV
VIHVTKEVKEVATLSCGHNVSVEELAQTRIYWQKDKKMVLTMMSGDMKIWPEYKNRTIFDITNNLSIMILALRPSDEGTYECVVLKYENDAFKREHLAEVTLSVKAD

SEQ ID NO: 2862 - protein, 107 aa, Artificial Sequence
  CD80 v436 IgV
VIHVTKEVKEVATLSCGHNVSVEELAQTRIYWQKEKKMVLTMMSGDVKIWPEYKNRTIFDITNNLSIMILALRPSDEGTYECVVLKYENDAFKREHLAEVTLSVKAD

SEQ ID NO: 2863 - protein, 107 aa, Artificial Sequence
  CD80 v437 IgV
VIHVTKEVKEVATLSCGHNVSVEELAQTRIYWQKDKKMVLTMMSGVVKIWPEYKNRTIFDITNNLSIMILALRPSDEGTYECVVLKYEKDAFKREHLAEVTLSVKAD

SEQ ID NO: 2864 - protein, 107 aa, Artificial Sequence
  CD80 v438 IgV
VIHVTKEVKEVATLSCGHNVSVEELAQTRIYWQKDKKMVLTMMSGVVNIWPEYKNRTIFDITNNLSIMILALRPSDEGTYECVVQKYEKDAFKREHLAEVTLSVKAD

SEQ ID NO: 2865 - protein, 107 aa, Artificial Sequence
  CD80 v439 IgV
VIHVTKEVKEVATLSCGHNVSVEELAQTRIYWQKDKKMVLTMMSGVVNIWPEYKNRTIFDITNNLSIMILALRPSDEGTYECVVLKYENDAFKREHLAEVTLSVKAD

SEQ ID NO: 2866 - protein, 107 aa, Artificial Sequence
  CD80 v440 IgV
VIHVTKEVKEVATLSCGHNVSVEELAQTRIYWQKDKKMVLTMMSGDVKIWPEYKNRTIFDITNNLSIMILALRPSDEGTYECVVQKYEKDAFKREHLAEVTLSVKAD

SEQ ID NO: 2867 - protein, 107 aa, Artificial Sequence
  CD80 v441 IgV
VIHVTKEVKEVATLSCGHNVSVEELAQTRIYWQKDKKMVLTMMSGDVNIWPEYKNRTIFDITNNLSIMILALRPSDEGTYECVVQKYENDAFKREHLAEVTLSVKAD

SEQ ID NO: 2868 - protein, 107 aa, Artificial Sequence
  CD80 v442 IgV
VIHVTKEVKEVATLSCGHNVSVEELEQTRIYWQKDKKMVLTMMSGDLNIWPEYKNRTIFDITNNLSIMILGLRPSDEGTYECVVLKYEKGAFKREHLAEVTLSVKAD

SEQ ID NO: 2869 - protein, 107 aa, Artificial Sequence
  CD80 v443 IgV
VIHVTKEVKEVATLSCGYNVSVEELAQTRIYWQKDKKMVLTMMSGDLNIWPEYKNRTIFDITNNLSIMILGLRPSDEGTYECVVLKYEKGAFKREHLAEVTLSVKAD

SEQ ID NO: 2870 - protein, 107 aa, Artificial Sequence
  CD80 v444 IgV
VIHVTKEVKEVATLSCGYNVSVEELEQTRIYWQKEKKMVLTMMSGDLNIWPEYKNRTIFDITNNLSIMILGLRPSDEGTYECVVLKYEKGAFKREHLAEVTLSVKAD

SEQ ID NO: 2871 - protein, 107 aa, Artificial Sequence
  CD80 v445 IgV
VIHVTKEVKEVATLSCGYNVSVEELEQTRIYWQKDKKMVLTMMSGDMNIWPEYKNRTIFDITNNLSIMILGLRPSDEGTYECVVLKYEKGAFKREHLAEVTLSVKAD

SEQ ID NO: 2872 - protein, 107 aa, Artificial Sequence
  CD80 v446 IgV
VIHVTKEVKEVATLSCGYNVSVEELEQTRIYWQKDKKMVLTMMSGDLNIWPEYKNRTIFDITNNLSIVILGLRPSDEGTYECVVLKYEKGAFKREHLAEVTLSVKAD

SEQ ID NO: 2873 - protein, 107 aa, Artificial Sequence
  CD80 v447 IgV
VIHVTKEVKEVATLSCGYNVSVEELEQTRIYWQKDKKMVLTMMSGDLNIWPEYKNRTIFDITNNLSIMILALRPSDEGTYECVVLKYEKGAFKREHLAEVTLSVKAD

SEQ ID NO: 2874 - protein, 107 aa, Artificial Sequence
  CD80 v448 IgV
VIHVTKEVKEVATLSCGYNVSVEELEQTRIYWQKDKKMVLTMMSGDLNIWPEYKNRTIFDITNNLSIMILGLRPSDEGTYECVVLKYEKDAFKREHLAEVTLSVKAD

SEQ ID NO: 2875 - protein, 107 aa, Artificial Sequence
  CD80 v449 IgV
VIHVTKEVKEVATLSCGHNVSVEELAQTRIYWQKDKKMVLTMMSGDLNIWPEYKNRTIFDITNNLSIMILGLRPSDEGTYECVVLKYEKGAFKREHLAEVTLSVKAD

SEQ ID NO: 2876 - protein, 107 aa, Artificial Sequence
  CD80 v450 IgV
VIHVTKEVKEVATLSCGYNVSVEELAQTRIYWQKEKKMVLTMMSGDLNIWPEYKNRTIFDITNNLSIMILGLRPSDEGTYECVVLKYEKGAFKREHLAEVTLSVKAD

SEQ ID NO: 2877 - protein, 107 aa, Artificial Sequence
  CD80 v451 IgV
VIHVTKEVKEVATLSCGYNVSVEELEQTRIYWQKEKKMVLTMMSGDMNIWPEYKNRTIFDITNNLSIMILGLRPSDEGTYECVVLKYEKGAFKREHLAEVTLSVKAD

SEQ ID NO: 2878 - protein, 107 aa, Artificial Sequence
  CD80 v452 IgV
VIHVTKEVKEVATLSCGYNVSVEELEQTRIYWQKDKKMVLTMMSGDMNIWPEYKNRTIFDITNNLSIVILGLRPSDEGTYECVVLKYEKGAFKREHLAEVTLSVKAD

SEQ ID NO: 2879 - protein, 107 aa, Artificial Sequence
  CD80 v453 IgV
VIHVTKEVKEVATLSCGYNVSVEELEQTRIYWQKDKKMVLTMMSGDLNIWPEYKNRTIFDITNNLSIVILALRPSDEGTYECVVLKYEKGAFKREHLAEVTLSVKAD

SEQ ID NO: 2880 - protein, 107 aa, Artificial Sequence
  CD80 v454 IgV
VIHVTKEVKEVATLSCGYNVSVEELEQTRIYWQKDKKMVLTMMSGDLNIWPEYKNRTIFDITNNLSIMILALRPSDEGTYECVVLKYEKDAFKREHLAEVTLSVKAD

SEQ ID NO: 2881 - protein, 107 aa, Artificial Sequence
  CD80 v455 IgV
VIHVTKEVKEVATLSCGHNVSVEELEQTRIYWQKEKKMVLTMMSGDLNIWPEYKNRTIFDITNNLSIMILGLRPSDEGTYECVVLKYEKGAFKREHLAEVTLSVKAD

SEQ ID NO: 2882 - protein, 107 aa, Artificial Sequence
  CD80 v456 IgV
VIHVTKEVKEVATLSCGHNVSVEELEQTRIYWQKDKKMVLTMMSGDMNIWPEYKNRTIFDITNNLSIMILGLRPSDEGTYECVVLKYEKGAFKREHLAEVTLSVKAD

SEQ ID NO: 2883 - protein, 107 aa, Artificial Sequence
  CD80 v457 IgV
VIHVTKEVKEVATLSCGHNVSVEELEQTRIYWQKDKKMVLTMMSGDLNIWPEYKNRTIFDITNNLSIVILGLRPSDEGTYECVVLKYEKGAFKREHLAEVTLSVKAD

SEQ ID NO: 2884 - protein, 107 aa, Artificial Sequence
  CD80 v458 IgV
VIHVTKEVKEVATLSCGHNVSVEELEQTRIYWQKDKKMVLTMMSGDLNIWPEYKNRTIFDITNNLSIMILALRPSDEGTYECVVLKYEKGAFKREHLAEVTLSVKAD

SEQ ID NO: 2885 - protein, 107 aa, Artificial Sequence
  CD80 v459 IgV
VIHVTKEVKEVATLSCGHNVSVEELEQTRIYWQKDKKMVLTMMSGDLNIWPEYKNRTIFDITNNLSIMILGLRPSDEGTYECVVLKYEKDAFKREHLAEVTLSVKAD

SEQ ID NO: 2886 - protein, 107 aa, Artificial Sequence
  CD80 v460 IgV
VIHVTKEVKEVATLSCGYNVSVEELAQTRIYWQKDKKMVLTMMSGDMNIWPEYKNRTIFDITNNLSIMILGLRPSDEGTYECVVLKYEKGAFKREHLAEVTLSVKAD

SEQ ID NO: 2887 - protein, 107 aa, Artificial Sequence
  CD80 v461 IgV
VIHVTKEVKEVATLSCGYNVSVEELAQTRIYWQKDKKMVLTMMSGDLNIWPEYKNRTIFDITNNLSIVILGLRPSDEGTYECVVLKYEKGAFKREHLAEVTLSVKAD

SEQ ID NO: 2888 - protein, 107 aa, Artificial Sequence
  CD80 v462 IgV
VIHVTKEVKEVATLSCGYNVSVEELAQTRIYWQKDKKMVLTMMSGDLNIWPEYKNRTIFDITNNLSIMILALRPSDEGTYECVVLKYEKGAFKREHLAEVTLSVKAD

SEQ ID NO: 2889 - protein, 107 aa, Artificial Sequence
  CD80 v463 IgV
VIHVTKEVKEVATLSCGYNVSVEELAQTRIYWQKDKKMVLTMMSGDLNIWPEYKNRTIFDITNNLSIMILGLRPSDEGTYECVVLKYEKDAFKREHLAEVTLSVKAD

SEQ ID NO: 2890 - protein, 107 aa, Artificial Sequence
  CD80 v464 IgV
VIHVTKEVKEVATLSCGYNVSVEELEQTRIYWQKEKKMVLTMMSGDLNIWPEYKNRTIFDITNNLSIVILGLRPSDEGTYECVVLKYEKGAFKREHLAEVTLSVKAD

SEQ ID NO: 2891 - protein, 107 aa, Artificial Sequence
  CD80 v465 IgV
VIHVTKEVKEVATLSCGYNVSVEELEQTRIYWQKEKKMVLTMMSGDLNIWPEYKNRTIFDITNNLSIMILALRPSDEGTYECVVLKYEKGAFKREHLAEVTLSVKAD

SEQ ID NO: 2892 - protein, 107 aa, Artificial Sequence
  CD80 v466 IgV
VIHVTKEVKEVATLSCGYNVSVEELEQTRIYWQKEKKMVLTMMSGDLNIWPEYKNRTIFDITNNLSIMILGLRPSDEGTYECVVLKYEKDAFKREHLAEVTLSVKAD

SEQ ID NO: 2893 - protein, 107 aa, Artificial Sequence
  CD80 v467 IgV
VIHVTKEVKEVATLSCGYNVSVEELEQTRIYWQKDKKMVLTMMSGDMNIWPEYKNRTIFDITNNLSIMILALRPSDEGTYECVVLKYEKGAFKREHLAEVTLSVKAD

SEQ ID NO: 2894 - protein, 107 aa, Artificial Sequence
  CD80 v468 IgV
VIHVTKEVKEVATLSCGYNVSVEELEQTRIYWQKDKKMVLTMMSGDMNIWPEYKNRTIFDITNNLSIMILGLRPSDEGTYECVVLKYEKDAFKREHLAEVTLSVKAD

SEQ ID NO: 2895 - protein, 107 aa, Artificial Sequence
  CD80 v469 IgV
VIHVTKEVKEVATLSCGYNVSVEELEQTRIYWQKDKKMVLTMMSGDLNIWPEYKNRTIFDITNNLSIVILGLRPSDEGTYECVVLKYEKDAFKREHLAEVTLSVKAD

SEQ ID NO: 2896 - protein, 107 aa, Artificial Sequence
  CD80 v470 IgV
VIHVTKEVKEVATLSCGHNVSVEELAQTRIYWQKEKKMVLTMMSGDLNIWPEYKNRTIFDITNNLSIMILGLRPSDEGTYECVVLKYEKGAFKREHLAEVTLSVKAD

SEQ ID NO: 2897 - protein, 107 aa, Artificial Sequence
  CD80 v471 IgV
VIHVTKEVKEVATLSCGYNVSVEELAQTRIYWQKEKKMVLTMMSGDMNIWPEYKNRTIFDITNNLSIMILGLRPSDEGTYECVVLKYEKGAFKREHLAEVTLSVKAD

SEQ ID NO: 2898 - protein, 107 aa, Artificial Sequence
  CD80 v472 IgV
VIHVTKEVKEVATLSCGYNVSVEELEQTRIYWQKEKKMVLTMMSGDMNIWPEYKNRTIFDITNNLSIVILGLRPSDEGTYECVVLKYEKGAFKREHLAEVTLSVKAD

SEQ ID NO: 2899 - protein, 107 aa, Artificial Sequence
  CD80 v473 IgV
VIHVTKEVKEVATLSCGYNVSVEELEQTRIYWQKDKKMVLTMMSGDMNIWPEYKNRTIFDITNNLSIVILALRPSDEGTYECVVLKYEKGAFKREHLAEVTLSVKAD

SEQ ID NO: 2900 - protein, 107 aa, Artificial Sequence
  CD80 v474 IgV
VIHVTKEVKEVATLSCGYNVSVEELEQTRIYWQKDKKMVLTMMSGDLNIWPEYKNRTIFDITNNLSIVILALRPSDEGTYECVVLKYEKDAFKREHLAEVTLSVKAD

SEQ ID NO: 2901 - protein, 107 aa, Artificial Sequence
  CD80 v475 IgV
VIHVTKEVKEVATLSCGHNVSVEELAQTRIYWQKDKKMVLTMMSGDMNIWPEYKNRTIFDITNNLSIMILGLRPSDEGTYECVVLKYEKGAFKREHLAEVTLSVKAD

SEQ ID NO: 2902 - protein, 107 aa, Artificial Sequence
  CD80 v476 IgV
VIHVTKEVKEVATLSCGHNVSVEELAQTRIYWQKDKKMVLTMMSGDLNIWPEYKNRTIFDITNNLSIVILGLRPSDEGTYECVVLKYEKGAFKREHLAEVTLSVKAD

SEQ ID NO: 2903 - protein, 107 aa, Artificial Sequence
  CD80 v477 IgV
VIHVTKEVKEVATLSCGHNVSVEELAQTRIYWQKDKKMVLTMMSGDLNIWPEYKNRTIFDITNNLSIMILALRPSDEGTYECVVLKYEKGAFKREHLAEVTLSVKAD

SEQ ID NO: 2904 - protein, 107 aa, Artificial Sequence
  CD80 v478 IgV
VIHVTKEVKEVATLSCGHNVSVEELAQTRIYWQKDKKMVLTMMSGDLNIWPEYKNRTIFDITNNLSIMILGLRPSDEGTYECVVLKYEKDAFKREHLAEVTLSVKAD

SEQ ID NO: 2905 - protein, 107 aa, Artificial Sequence
  CD80 v479 IgV
VIHVTKEVKEVATLSCGHNVSVEELEQTRIYWQKEKKMVLTMMSGDMNIWPEYKNRTIFDITNNLSIMILGLRPSDEGTYECVVLKYEKGAFKREHLAEVTLSVKAD

SEQ ID NO: 2906 - protein, 107 aa, Artificial Sequence
  CD80 v480 IgV
VIHVTKEVKEVATLSCGHNVSVEELEQTRIYWQKEKKMVLTMMSGDLNIWPEYKNRTIFDITNNLSIVILGLRPSDEGTYECVVLKYEKGAFKREHLAEVTLSVKAD

SEQ ID NO: 2907 - protein, 107 aa, Artificial Sequence
  CD80 v481 IgV
VIHVTKEVKEVATLSCGHNVSVEELEQTRIYWQKEKKMVLTMMSGDLNIWPEYKNRTIFDITNNLSIMILALRPSDEGTYECVVLKYEKGAFKREHLAEVTLSVKAD

SEQ ID NO: 2908 - protein, 107 aa, Artificial Sequence
  CD80 v482 IgV
VIHVTKEVKEVATLSCGHNVSVEELEQTRIYWQKEKKMVLTMMSGDLNIWPEYKNRTIFDITNNLSIMILGLRPSDEGTYECVVLKYEKDAFKREHLAEVTLSVKAD

SEQ ID NO: 2909 - protein, 107 aa, Artificial Sequence
  CD80 v483 IgV
VIHVTKEVKEVATLSCGHNVSVEELEQTRIYWQKDKKMVLTMMSGDMNIWPEYKNRTIFDITNNLSIVILGLRPSDEGTYECVVLKYEKGAFKREHLAEVTLSVKAD

SEQ ID NO: 2910 - protein, 107 aa, Artificial Sequence
  CD80 v484 IgV
VIHVTKEVKEVATLSCGHNVSVEELEQTRIYWQKDKKMVLTMMSGDMNIWPEYKNRTIFDITNNLSIMILALRPSDEGTYECVVLKYEKGAFKREHLAEVTLSVKAD

SEQ ID NO: 2911 - protein, 107 aa, Artificial Sequence
  CD80 v485 IgV
VIHVTKEVKEVATLSCGHNVSVEELEQTRIYWQKDKKMVLTMMSGDMNIWPEYKNRTIFDITNNLSIMILGLRPSDEGTYECVVLKYEKDAFKREHLAEVTLSVKAD

SEQ ID NO: 2912 - protein, 107 aa, Artificial Sequence
  CD80 v486 IgV
VIHVTKEVKEVATLSCGHNVSVEELEQTRIYWQKDKKMVLTMMSGDLNIWPEYKNRTIFDITNNLSIVILALRPSDEGTYECVVLKYEKGAFKREHLAEVTLSVKAD

SEQ ID NO: 2913 - protein, 107 aa, Artificial Sequence
  CD80 v487 IgV
VIHVTKEVKEVATLSCGHNVSVEELEQTRIYWQKDKKMVLTMMSGDLNIWPEYKNRTIFDITNNLSIMILALRPSDEGTYECVVLKYEKDAFKREHLAEVTLSVKAD

SEQ ID NO: 2914 - protein, 107 aa, Artificial Sequence
  CD80 v488 IgV
VIHVTKEVKEVATLSCGYNVSVEELAQTRIYWQKEKKMVLTMMSGDLNIWPEYKNRTIFDITNNLSIVILGLRPSDEGTYECVVLKYEKGAFKREHLAEVTLSVKAD

SEQ ID NO: 2915 - protein, 107 aa, Artificial Sequence
  CD80 v489 IgV
VIHVTKEVKEVATLSCGYNVSVEELAQTRIYWQKEKKMVLTMMSGDLNIWPEYKNRTIFDITNNLSIMILALRPSDEGTYECVVLKYEKGAFKREHLAEVTLSVKAD

SEQ ID NO: 2916 - protein, 107 aa, Artificial Sequence
  CD80 v490 IgV
VIHVTKEVKEVATLSCGYNVSVEELAQTRIYWQKEKKMVLTMMSGDLNIWPEYKNRTIFDITNNLSIMILGLRPSDEGTYECVVLKYEKDAFKREHLAEVTLSVKAD

SEQ ID NO: 2917 - protein, 107 aa, Artificial Sequence
  CD80 v491 IgV
VIHVTKEVKEVATLSCGYNVSVEELAQTRIYWQKDKKMVLTMMSGDMNIWPEYKNRTIFDITNNLSIVILGLRPSDEGTYECVVLKYEKGAFKREHLAEVTLSVKAD

SEQ ID NO: 2918 - protein, 107 aa, Artificial Sequence
  CD80 v492 IgV
VIHVTKEVKEVATLSCGYNVSVEELAQTRIYWQKDKKMVLTMMSGDMNIWPEYKNRTIFDITNNLSIMILALRPSDEGTYECVVLKYEKGAFKREHLAEVTLSVKAD

SEQ ID NO: 2919 - protein, 107 aa, Artificial Sequence
  CD80 v493 IgV
VIHVTKEVKEVATLSCGYNVSVEELAQTRIYWQKDKKMVLTMMSGDMNIWPEYKNRTIFDITNNLSIMILGLRPSDEGTYECVVLKYEKDAFKREHLAEVTLSVKAD

SEQ ID NO: 2920 - protein, 107 aa, Artificial Sequence
  CD80 v494 IgV
VIHVTKEVKEVATLSCGYNVSVEELAQTRIYWQKDKKMVLTMMSGDLNIWPEYKNRTIFDITNNLSIVILALRPSDEGTYECVVLKYEKGAFKREHLAEVTLSVKAD

SEQ ID NO: 2921 - protein, 107 aa, Artificial Sequence
  CD80 v495 IgV
VIHVTKEVKEVATLSCGYNVSVEELAQTRIYWQKDKKMVLTMMSGDLNIWPEYKNRTIFDITNNLSIVILGLRPSDEGTYECVVLKYEKDAFKREHLAEVTLSVKAD

SEQ ID NO: 2922 - protein, 107 aa, Artificial Sequence
  CD80 v496 IgV
VIHVTKEVKEVATLSCGYNVSVEELAQTRIYWQKDKKMVLTMMSGDLNIWPEYKNRTIFDITNNLSIMILALRPSDEGTYECVVLKYEKDAFKREHLAEVTLSVKAD

SEQ ID NO: 2923 - protein, 107 aa, Artificial Sequence
  CD80 v497 IgV
VIHVTKEVKEVATLSCGYNVSVEELEQTRIYWQKEKKMVLTMMSGDMNIWPEYKNRTIFDITNNLSIMILALRPSDEGTYECVVLKYEKGAFKREHLAEVTLSVKAD

SEQ ID NO: 2924 - protein, 107 aa, Artificial Sequence
  CD80 v498 IgV
VIHVTKEVKEVATLSCGYNVSVEELEQTRIYWQKEKKMVLTMMSGDMNIWPEYKNRTIFDITNNLSIMILGLRPSDEGTYECVVLKYEKDAFKREHLAEVTLSVKAD

SEQ ID NO: 2925 - protein, 107 aa, Artificial Sequence
  CD80 v499 IgV
VIHVTKEVKEVATLSCGYNVSVEELEQTRIYWQKEKKMVLTMMSGDLNIWPEYKNRTIFDITNNLSIVILALRPSDEGTYECVVLKYEKGAFKREHLAEVTLSVKAD

SEQ ID NO: 2926 - protein, 107 aa, Artificial Sequence
  CD80 v500 IgV
VIHVTKEVKEVATLSCGYNVSVEELEQTRIYWQKEKKMVLTMMSGDLNIWPEYKNRTIFDITNNLSIVILGLRPSDEGTYECVVLKYEKDAFKREHLAEVTLSVKAD

SEQ ID NO: 2927 - protein, 107 aa, Artificial Sequence
  CD80 v501 IgV
VIHVTKEVKEVATLSCGYNVSVEELEQTRIYWQKEKKMVLTMMSGDLNIWPEYKNRTIFDITNNLSIMILALRPSDEGTYECVVLKYEKDAFKREHLAEVTLSVKAD

SEQ ID NO: 2928 - protein, 107 aa, Artificial Sequence
  CD80 v502 IgV
VIHVTKEVKEVATLSCGYNVSVEELEQTRIYWQKDKKMVLTMMSGDMNIWPEYKNRTIFDITNNLSIVILGLRPSDEGTYECVVLKYEKDAFKREHLAEVTLSVKAD

SEQ ID NO: 2929 - protein, 107 aa, Artificial Sequence
  CD80 v503 IgV
VIHVTKEVKEVATLSCGYNVSVEELEQTRIYWQKDKKMVLTMMSGDMNIWPEYKNRTIFDITNNLSIMILALRPSDEGTYECVVLKYEKDAFKREHLAEVTLSVKAD

SEQ ID NO: 2930 - protein, 208 aa, Artificial Sequence
  CD80 v504 ECD
VIHVTKEVKEVATLSCGYNVSVEELAQTRIYWQKDKKMVLTMMSGDVNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2931 - protein, 208 aa, Artificial Sequence
  CD80 v505 ECD
VIHVTKEVKEVATLSCGCNVSVEELPQTRIYWQKDKKMVLTMMSGDLNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2932 - protein, 208 aa, Artificial Sequence
  CD80 v506 ECD
VIHVTKEVKEVATLSCGINVSVEELPQTRIYWQKDKKMVLTMMSGDVNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2933 - protein, 208 aa, Artificial Sequence
  CD80 v507 ECD
VIHVTKEVKEVATLSCGLNVSVEELNQTRIYWQKEKKMVLTMMSGEMNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2934 - protein, 208 aa, Artificial Sequence
  CD80 v508 ECD
VIHVTKEVKEVATLSCGLNVSVEELAQTRIYWQKDKKMVLTMMSGDVNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2935 - protein, 208 aa, Artificial Sequence
  CD80 v509 ECD
VIHVTKEVKEVATLSCGTNVSVEELNQTRIYWQKDKKMVLTMMSGDLNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2936 - protein, 208 aa, Artificial Sequence
  CD80 v510 ECD
VIHVTKEVKEVATLSCGVNVSVEELKQTRIYWQKDKKMVLTMMSGDLNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2937 - protein, 208 aa, Artificial Sequence
  CD80 v511 ECD
VIHVTKEVKEVATLSCGVNVSVEELNQTRIYWQKDKKMVLTMMSGDVNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2938 - protein, 208 aa, Artificial Sequence
  CD80 v512 ECD
VIHVTKEVKEVATLSCGVNVSVEELPQTRIYWQKDKKMVLTMMSGDVNIWPEYKNRTIFDITNNLSILILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2939 - protein, 208 aa, Artificial Sequence
  CD80 v513 ECD
VIHVTKEVKEVATLSCGVNVSVEELPQTRIYWQKDKKMVLTMMSGDLNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2940 - protein, 208 aa, Artificial Sequence
  CD80 v514 ECD
VIHVTKEVKEVATLSCGVNVSVEELAQTRIYWQKDKKMVLTMMSGDVNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2941 - protein, 208 aa, Artificial Sequence
  CD80 v515 ECD
VIHVTKEVKEVATLSCGYNVSVEELPQTRIYWQKDKKMVLTMMSGDINIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2942 - protein, 208 aa, Artificial Sequence
  CD80 v516 ECD
VIHVTKEVKEVATLSCGYNVSVEELPQTRIYWQKDKKMVLTMMSGDVNIWPEYKNRTIFDITNNLSIMILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2943 - protein, 208 aa, Artificial Sequence
  CD80 v517 ECD
VIHVTKEVKEVATLSCGYNVSVEELAQTRIYWQKDKKMVLTMMSGDVNIWPEYKNRTIFDITNNLSILILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2944 - protein, 208 aa, Artificial Sequence
  CD80 v518 ECD
VIHVTKEVKEVATLSCGYNVSVEELAQTRIYWQKDKKMVLTMMSGDVNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2945 - protein, 208 aa, Artificial Sequence
  CD80 v519 ECD
VIHVTKEVKEVATLSCGHNVSVEELPQTRIYWQKDKKMVLTMMSGDINIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2946 - protein, 208 aa, Artificial Sequence
  CD80 v520 ECD
VIHVTKEVKEVATLSCGVNVSVEELGQTRIYWQKDKKMVLTMMSGDVNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2947 - protein, 208 aa, Artificial Sequence
  CD80 v521 ECD
VIHVTKEVKEVATLSCGVNVSVEELSQTRIYWQKDKKMVLTMMSGDLNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2948 - protein, 208 aa, Artificial Sequence
  CD80 v522 ECD
VIHVTKEVKEVATLSCGVNVSVEELRQTRIYWQKDKKMVLTMMSGDLNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2949 - protein, 208 aa, Artificial Sequence
  CD80 v523 ECD
VIHVTKEVKEVATLSCGVNVSVEELDQTRIYWQKDKKMVLTMMSGDVNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2950 - protein, 208 aa, Artificial Sequence
  CD80 v524 ECD
VIHVTKEVKEVATLSCGVNVSVEELQQTRIYWQKDKKMVLTMMSGDVNIWPEYKNRTIFDITNNLSILILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2951 - protein, 208 aa, Artificial Sequence
  CD80 v525 ECD
VIHVTKEVKEVATLSCGANVSVEELPQTRIYWQKDKKMVLTMMSGDLNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2952 - protein, 208 aa, Artificial Sequence
  CD80 v526 ECD
VIHVTKEVKEVATLSCGANVSVEELNQTRIYWQKDKKMVLTMMSGDLNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2953 - protein, 208 aa, Artificial Sequence
  CD80 v527 ECD
VIHVTKEVKEVATLSCGFNVSVEELPQTRIYWQKDKKMVLTMMSGDINIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2954 - protein, 208 aa, Artificial Sequence
  CD80 v528 ECD
VIHVTKEVKEVATLSCGFNVSVEELHQTRIYWQKDKKMVLTMMSGDLNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2955 - protein, 208 aa, Artificial Sequence
  CD80 v529 ECD
VIHVTKEVKEVATLSCGFNVSVEELNQTRIYWQKDKKMVLTMMSGDVNIWPEYKNRTIFDITNNLSIMILGLRPSDEGTYECVVLKYEKKAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2956 - protein, 208 aa, Artificial Sequence
  CD80 v530 ECD
VIHVTKEVKEVATLSCGYNVSVEELNQTRIYWQKDKKMVLTMMSGDFNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2957 - protein, 208 aa, Artificial Sequence
  CD80 v531 ECD
VIHVTKEVKEVATLSCGYNVSVEELPQTRIYWQKDKKMVLTMMSGDYNIWPEYKNRTIFDITNNLSIIILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2958 - protein, 208 aa, Artificial Sequence
  CD80 v532 ECD
VIHVTKEVKEVATLSCGYNVSVEELQQTRIYWQKDKKMVLTMMSGDTNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2959 - protein, 208 aa, Artificial Sequence
  CD80 v533 ECD
VIHVTKEVKEVATLSCGRNVSVEELPQTRIYWQKDKKMVLTMMSGNVNIWPEYKNRTIFDITNNLSIMILGLRPSDEGTYECVVLKYEKPAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2960 - protein, 208 aa, Artificial Sequence
  CD80 v534 ECD
VIHVTKEVKEVATLSCGFNVSVEELDQTRIYWQKDKKMVLTMMSGETNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 2961 - protein, 101 aa, Artificial Sequence
  CD80 v504 IgV
VIHVTKEVKEVATLSCGYNVSVEELAQTRIYWQKDKKMVLTMMSGDVNIWPEYKNRTIFDITNNLSIMILGLRPSDEGTYECVVLKYEKDAFKREHLAEVT

SEQ ID NO: 2962 - protein, 101 aa, Artificial Sequence
  CD80 v505 IgV
VIHVTKEVKEVATLSCGCNVSVEELPQTRIYWQKDKKMVLTMMSGDLNIWPEYKNRTIFDITNNLSIMILGLRPSDEGTYECVVLKYEKDAFKREHLAEVT

SEQ ID NO: 2963 - protein, 101 aa, Artificial Sequence
  CD80 v506 IgV
VIHVTKEVKEVATLSCGINVSVEELPQTRIYWQKDKKMVLTMMSGDVNIWPEYKNRTIFDITNNLSIMILGLRPSDEGTYECVVLKYEKDAFKREHLAEVT

SEQ ID NO: 2964 - protein, 101 aa, Artificial Sequence
  CD80 v507 IgV
VIHVTKEVKEVATLSCGLNVSVEELNQTRIYWQKEKKMVLTMMSGEMNIWPEYKNRTIFDITNNLSIMILGLRPSDEGTYECVVLKYEKGAFKREHLAEVT

SEQ ID NO: 2965 - protein, 101 aa, Artificial Sequence
  CD80 v508 IgV
VIHVTKEVKEVATLSCGLNVSVEELAQTRIYWQKDKKMVLTMMSGDVNIWPEYKNRTIFDITNNLSIMILGLRPSDEGTYECVVLKYEKGAFKREHLAEVT

SEQ ID NO: 2966 - protein, 101 aa, Artificial Sequence
  CD80 v509 IgV
VIHVTKEVKEVATLSCGTNVSVEELNQTRIYWQKDKKMVLTMMSGDLNIWPEYKNRTIFDITNNLSIMILGLRPSDEGTYECVVLKYEKDAFKREHLAEVT

SEQ ID NO: 2967 - protein, 101 aa, Artificial Sequence
  CD80 v510 IgV
VIHVTKEVKEVATLSCGVNVSVEELKQTRIYWQKDKKMVLTMMSGDLNIWPEYKNRTIFDITNNLSIMILGLRPSDEGTYECVVLKYEKDAFKREHLAEVT

SEQ ID NO: 2968 - protein, 101 aa, Artificial Sequence
  CD80 v511 IgV
VIHVTKEVKEVATLSCGVNVSVEELNQTRIYWQKDKKMVLTMMSGDVNIWPEYKNRTIFDITNNLSIMILGLRPSDEGTYECVVLKYEKDAFKREHLAEVT

SEQ ID NO: 2969 - protein, 101 aa, Artificial Sequence
  CD80 v512 IgV
VIHVTKEVKEVATLSCGVNVSVEELPQTRIYWQKDKKMVLTMMSGDVNIWPEYKNRTIFDITNNLSILILGLRPSDEGTYECVVLKYEKDAFKREHLAEVT

SEQ ID NO: 2970 - protein, 101 aa, Artificial Sequence
  CD80 v513 IgV
VIHVTKEVKEVATLSCGVNVSVEELPQTRIYWQKDKKMVLTMMSGDLNIWPEYKNRTIFDITNNLSIMILGLRPSDEGTYECVVLKYEKDAFKREHLAEVT

SEQ ID NO: 2971 - protein, 101 aa, Artificial Sequence
  CD80 v514 IgV
VIHVTKEVKEVATLSCGVNVSVEELAQTRIYWQKDKKMVLTMMSGDVNIWPEYKNRTIFDITNNLSIMILGLRPSDEGTYECVVLKYEKGAFKREHLAEVT

SEQ ID NO: 2972 - protein, 101 aa, Artificial Sequence
  CD80 v515 IgV
VIHVTKEVKEVATLSCGYNVSVEELPQTRIYWQKDKKMVLTMMSGDINIWPEYKNRTIFDITNNLSIMILGLRPSDEGTYECVVLKYEKDAFKREHLAEVT

SEQ ID NO: 2973 - protein, 101 aa, Artificial Sequence
  CD80 v516 IgV
VIHVTKEVKEVATLSCGYNVSVEELPQTRIYWQKDKKMVLTMMSGDVNIWPEYKNRTIFDITNNLSIMILGLRPSDEGTYECVVLKYEKDAFKREHLAEVT

SEQ ID NO: 2974 - protein, 101 aa, Artificial Sequence
  CD80 v517 IgV
VIHVTKEVKEVATLSCGYNVSVEELAQTRIYWQKDKKMVLTMMSGDVNIWPEYKNRTIFDITNNLSILILGLRPSDEGTYECVVLKYEKGAFKREHLAEVT

SEQ ID NO: 2975 - protein, 101 aa, Artificial Sequence
  CD80 v518 IgV
VIHVTKEVKEVATLSCGYNVSVEELAQTRIYWQKDKKMVLTMMSGDVNIWPEYKNRTIFDITNNLSIMILGLRPSDEGTYECVVLKYEKGAFKREHLAEVT

SEQ ID NO: 2976 - protein, 101 aa, Artificial Sequence
  CD80 v519 IgV
VIHVTKEVKEVATLSCGHNVSVEELPQTRIYWQKDKKMVLTMMSGDINIWPEYKNRTIFDITNNLSIMILGLRPSDEGTYECVVLKYEKGAFKREHLAEVT

SEQ ID NO: 2977 - protein, 101 aa, Artificial Sequence
  CD80 v520 IgV
VIHVTKEVKEVATLSCGVNVSVEELGQTRIYWQKDKKMVLTMMSGDVNIWPEYKNRTIFDITNNLSIMILGLRPSDEGTYECVVLKYEKGAFKREHLAEVT

SEQ ID NO: 2978 - protein, 101 aa, Artificial Sequence
  CD80 v521 IgV
VIHVTKEVKEVATLSCGVNVSVEELSQTRIYWQKDKKMVLTMMSGDLNIWPEYKNRTIFDITNNLSIMILGLRPSDEGTYECVVLKYEKGAFKREHLAEVT

SEQ ID NO: 2979 - protein, 101 aa, Artificial Sequence
  CD80 v522 IgV
VIHVTKEVKEVATLSCGVNVSVEELRQTRIYWQKDKKMVLTMMSGDLNIWPEYKNRTIFDITNNLSIMILGLRPSDEGTYECVVLKYEKGAFKREHLAEVT

SEQ ID NO: 2980 - protein, 101 aa, Artificial Sequence
  CD80 v523 IgV
VIHVTKEVKEVATLSCGVNVSVEELDQTRIYWQKDKKMVLTMMSGDVNIWPEYKNRTIFDITNNLSIMILGLRPSDEGTYECVVLKYEKGAFKREHLAEVT

SEQ ID NO: 2981 - protein, 101 aa, Artificial Sequence
  CD80 v524 IgV
VIHVTKEVKEVATLSCGVNVSVEELQQTRIYWQKDKKMVLTMMSGDVNIWPEYKNRTIFDITNNLSILILGLRPSDEGTYECVVLKYEKGAFKREHLAEVT

SEQ ID NO: 2982 - protein, 101 aa, Artificial Sequence
  CD80 v525 IgV
VIHVTKEVKEVATLSCGANVSVEELPQTRIYWQKDKKMVLTMMSGDLNIWPEYKNRTIFDITNNLSIMILGLRPSDEGTYECVVLKYEKGAFKREHLAEVT

SEQ ID NO: 2983 - protein, 101 aa, Artificial Sequence
  CD80 v526 IgV
VIHVTKEVKEVATLSCGANVSVEELNQTRIYWQKDKKMVLTMMSGDLNIWPEYKNRTIFDITNNLSIMILGLRPSDEGTYECVVLKYEKGAFKREHLAEVT

SEQ ID NO: 2984 - protein, 101 aa, Artificial Sequence
  CD80 v527 IgV
VIHVTKEVKEVATLSCGFNVSVEELPQTRIYWQKDKKMVLTMMSGDINIWPEYKNRTIFDITNNLSIMILGLRPSDEGTYECVVLKYEKGAFKREHLAEVT

SEQ ID NO: 2985 - protein, 101 aa, Artificial Sequence
  CD80 v528 IgV
VIHVTKEVKEVATLSCGFNVSVEELHQTRIYWQKDKKMVLTMMSGDLNIWPEYKNRTIFDITNNLSIMILGLRPSDEGTYECVVLKYEKGAFKREHLAEVT

SEQ ID NO: 2986 - protein, 101 aa, Artificial Sequence
  CD80 v529 IgV
VIHVTKEVKEVATLSCGFNVSVEELNQTRIYWQKDKKMVLTMMSGDVNIWPEYKNRTIFDITNNLSIMILGLRPSDEGTYECVVLKYEKKAFKREHLAEVT

SEQ ID NO: 2987 - protein, 101 aa, Artificial Sequence
  CD80 v530 IgV
VIHVTKEVKEVATLSCGYNVSVEELNQTRIYWQKDKKMVLTMMSGDFNIWPEYKNRTIFDITNNLSIMILGLRPSDEGTYECVVLKYEKGAFKREHLAEVT

SEQ ID NO: 2988 - protein, 101 aa, Artificial Sequence
  CD80 v531 IgV
VIHVTKEVKEVATLSCGYNVSVEELPQTRIYWQKDKKMVLTMMSGDYNIWPEYKNRTIFDITNNLSIIILGLRPSDEGTYECVVLKYEKGAFKREHLAEVT

SEQ ID NO: 2989 - protein, 101 aa, Artificial Sequence
  CD80 v532 IgV
VIHVTKEVKEVATLSCGYNVSVEELQQTRIYWQKDKKMVLTMMSGDTNIWPEYKNRTIFDITNNLSIMILGLRPSDEGTYECVVLKYEKGAFKREHLAEVT

SEQ ID NO: 2990 - protein, 101 aa, Artificial Sequence
  CD80 v533 IgV
VIHVTKEVKEVATLSCGRNVSVEELPQTRIYWQKDKKMVLTMMSGNVNIWPEYKNRTIFDITNNLSIMILGLRPSDEGTYECVVLKYEKPAFKREHLAEVT

SEQ ID NO: 2991 - protein, 101 aa, Artificial Sequence
  CD80 v534 IgV
VIHVTKEVKEVATLSCGFNVSVEELDQTRIYWQKDKKMVLTMMSGETNIWPEYKNRTIFDITNNLSIMILGLRPSDEGTYECVVLKYEKGAFKREHLAEVT

SEQ ID NO: 2992 - protein, 107 aa, Artificial Sequence
  CD80 v504 IgV
VIHVTKEVKEVATLSCGYNVSVEELAQTRIYWQKDKKMVLTMMSGDVNIWPEYKNRTIFDITNNLSIMILGLRPSDEGTYECVVLKYEKDAFKREHLAEVTLSVKAD

SEQ ID NO: 2993 - protein, 107 aa, Artificial Sequence
  CD80 v505 IgV
VIHVTKEVKEVATLSCGCNVSVEELPQTRIYWQKDKKMVLTMMSGDLNIWPEYKNRTIFDITNNLSIMILGLRPSDEGTYECVVLKYEKDAFKREHLAEVTLSVKAD

SEQ ID NO: 2994 - protein, 107 aa, Artificial Sequence
  CD80 v506 IgV
VIHVTKEVKEVATLSCGINVSVEELPQTRIYWQKDKKMVLTMMSGDVNIWPEYKNRTIFDITNNLSIMILGLRPSDEGTYECVVLKYEKDAFKREHLAEVTLSVKAD

SEQ ID NO: 2995 - protein, 107 aa, Artificial Sequence
  CD80 v507 IgV
VIHVTKEVKEVATLSCGLNVSVEELNQTRIYWQKEKKMVLTMMSGEMNIWPEYKNRTIFDITNNLSIMILGLRPSDEGTYECVVLKYEKGAFKREHLAEVTLSVKAD

SEQ ID NO: 2996 - protein, 107 aa, Artificial Sequence
  CD80 v508 IgV
VIHVTKEVKEVATLSCGLNVSVEELAQTRIYWQKDKKMVLTMMSGDVNIWPEYKNRTIFDITNNLSIMILGLRPSDEGTYECVVLKYEKGAFKREHLAEVTLSVKAD

SEQ ID NO: 2997 - protein, 107 aa, Artificial Sequence
  CD80 v509 IgV
VIHVTKEVKEVATLSCGTNVSVEELNQTRIYWQKDKKMVLTMMSGDLNIWPEYKNRTIFDITNNLSIMILGLRPSDEGTYECVVLKYEKDAFKREHLAEVTLSVKAD

SEQ ID NO: 2998 - protein, 107 aa, Artificial Sequence
  CD80 v510 IgV
VIHVTKEVKEVATLSCGVNVSVEELKQTRIYWQKDKKMVLTMMSGDLNIWPEYKNRTIFDITNNLSIMILGLRPSDEGTYECVVLKYEKDAFKREHLAEVTLSVKAD

SEQ ID NO: 2999 - protein, 107 aa, Artificial Sequence
  CD80 v511 IgV
VIHVTKEVKEVATLSCGVNVSVEELNQTRIYWQKDKKMVLTMMSGDVNIWPEYKNRTIFDITNNLSIMILGLRPSDEGTYECVVLKYEKDAFKREHLAEVTLSVKAD

SEQ ID NO: 3000 - protein, 107 aa, Artificial Sequence
  CD80 v512 IgV
VIHVTKEVKEVATLSCGVNVSVEELPQTRIYWQKDKKMVLTMMSGDVNIWPEYKNRTIFDITNNLSILILGLRPSDEGTYECVVLKYEKDAFKREHLAEVTLSVKAD

SEQ ID NO: 3001 - protein, 107 aa, Artificial Sequence
  CD80 v513 IgV
VIHVTKEVKEVATLSCGVNVSVEELPQTRIYWQKDKKMVLTMMSGDLNIWPEYKNRTIFDITNNLSIMILGLRPSDEGTYECVVLKYEKDAFKREHLAEVTLSVKAD

SEQ ID NO: 3002 - protein, 107 aa, Artificial Sequence
  CD80 v514 IgV
VIHVTKEVKEVATLSCGVNVSVEELAQTRIYWQKDKKMVLTMMSGDVNIWPEYKNRTIFDITNNLSIMILGLRPSDEGTYECVVLKYEKGAFKREHLAEVTLSVKAD

SEQ ID NO: 3003 - protein, 107 aa, Artificial Sequence
  CD80 v515 IgV
VIHVTKEVKEVATLSCGYNVSVEELPQTRIYWQKDKKMVLTMMSGDINIWPEYKNRTIFDITNNLSIMILGLRPSDEGTYECVVLKYEKDAFKREHLAEVTLSVKAD

SEQ ID NO: 3004 - protein, 107 aa, Artificial Sequence
  CD80 v516 IgV
VIHVTKEVKEVATLSCGYNVSVEELPQTRIYWQKDKKMVLTMMSGDVNIWPEYKNRTIFDITNNLSIMILGLRPSDEGTYECVVLKYEKDAFKREHLAEVTLSVKAD

SEQ ID NO: 3005 - protein, 107 aa, Artificial Sequence
  CD80 v517 IgV
VIHVTKEVKEVATLSCGYNVSVEELAQTRIYWQKDKKMVLTMMSGDVNIWPEYKNRTIFDITNNLSILILGLRPSDEGTYECVVLKYEKGAFKREHLAEVTLSVKAD

SEQ ID NO: 3006 - protein, 107 aa, Artificial Sequence
  CD80 v518 IgV
VIHVTKEVKEVATLSCGYNVSVEELAQTRIYWQKDKKMVLTMMSGDVNIWPEYKNRTIFDITNNLSIMILGLRPSDEGTYECVVLKYEKGAFKREHLAEVTLSVKAD

SEQ ID NO: 3007 - protein, 107 aa, Artificial Sequence
  CD80 v519 IgV
VIHVTKEVKEVATLSCGHNVSVEELPQTRIYWQKDKKMVLTMMSGDINIWPEYKNRTIFDITNNLSIMILGLRPSDEGTYECVVLKYEKGAFKREHLAEVTLSVKAD

SEQ ID NO: 3008 - protein, 107 aa, Artificial Sequence
  CD80 v520 IgV
VIHVTKEVKEVATLSCGVNVSVEELGQTRIYWQKDKKMVLTMMSGDVNIWPEYKNRTIFDITNNLSIMILGLRPSDEGTYECVVLKYEKGAFKREHLAEVTLSVKAD

SEQ ID NO: 3009 - protein, 107 aa, Artificial Sequence
  CD80 v521 IgV
VIHVTKEVKEVATLSCGVNVSVEELSQTRIYWQKDKKMVLTMMSGDLNIWPEYKNRTIFDITNNLSIMILGLRPSDEGTYECVVLKYEKGAFKREHLAEVTLSVKAD

SEQ ID NO: 3010 - protein, 107 aa, Artificial Sequence
  CD80 v522 IgV
VIHVTKEVKEVATLSCGVNVSVEELRQTRIYWQKDKKMVLTMMSGDLNIWPEYKNRTIFDITNNLSIMILGLRPSDEGTYECVVLKYEKGAFKREHLAEVTLSVKAD

SEQ ID NO: 3011 - protein, 107 aa, Artificial Sequence
  CD80 v523 IgV
VIHVTKEVKEVATLSCGVNVSVEELDQTRIYWQKDKKMVLTMMSGDVNIWPEYKNRTIFDITNNLSIMILGLRPSDEGTYECVVLKYEKGAFKREHLAEVTLSVKAD

SEQ ID NO: 3012 - protein, 107 aa, Artificial Sequence
  CD80 v524 IgV
VIHVTKEVKEVATLSCGVNVSVEELQQTRIYWQKDKKMVLTMMSGDVNIWPEYKNRTIFDITNNLSILILGLRPSDEGTYECVVLKYEKGAFKREHLAEVTLSVKAD

SEQ ID NO: 3013 - protein, 107 aa, Artificial Sequence
  CD80 v525 IgV
VIHVTKEVKEVATLSCGANVSVEELPQTRIYWQKDKKMVLTMMSGDLNIWPEYKNRTIFDITNNLSIMILGLRPSDEGTYECVVLKYEKGAFKREHLAEVTLSVKAD

SEQ ID NO: 3014 - protein, 107 aa, Artificial Sequence
  CD80 v526 IgV
VIHVTKEVKEVATLSCGANVSVEELNQTRIYWQKDKKMVLTMMSGDLNIWPEYKNRTIFDITNNLSIMILGLRPSDEGTYECVVLKYEKGAFKREHLAEVTLSVKAD

SEQ ID NO: 3015 - protein, 107 aa, Artificial Sequence
  CD80 v527 IgV
VIHVTKEVKEVATLSCGFNVSVEELPQTRIYWQKDKKMVLTMMSGDINIWPEYKNRTIFDITNNLSIMILGLRPSDEGTYECVVLKYEKGAFKREHLAEVTLSVKAD

SEQ ID NO: 3016 - protein, 107 aa, Artificial Sequence
  CD80 v528 IgV
VIHVTKEVKEVATLSCGFNVSVEELHQTRIYWQKDKKMVLTMMSGDLNIWPEYKNRTIFDITNNLSIMILGLRPSDEGTYECVVLKYEKGAFKREHLAEVTLSVKAD

SEQ ID NO: 3017 - protein, 107 aa, Artificial Sequence
  CD80 v529 IgV
VIHVTKEVKEVATLSCGFNVSVEELNQTRIYWQKDKKMVLTMMSGDVNIWPEYKNRTIFDITNNLSIMILGLRPSDEGTYECVVLKYEKKAFKREHLAEVTLSVKAD

SEQ ID NO: 3018 - protein, 107 aa, Artificial Sequence
  CD80 v530 IgV
VIHVTKEVKEVATLSCGYNVSVEELNQTRIYWQKDKKMVLTMMSGDFNIWPEYKNRTIFDITNNLSIMILGLRPSDEGTYECVVLKYEKGAFKREHLAEVTLSVKAD

SEQ ID NO: 3019 - protein, 107 aa, Artificial Sequence
  CD80 v531 IgV
VIHVTKEVKEVATLSCGYNVSVEELPQTRIYWQKDKKMVLTMMSGDYNIWPEYKNRTIFDITNNLSIIILGLRPSDEGTYECVVLKYEKGAFKREHLAEVTLSVKAD

SEQ ID NO: 3020 - protein, 107 aa, Artificial Sequence
  CD80 v532 IgV
VIHVTKEVKEVATLSCGYNVSVEELQQTRIYWQKDKKMVLTMMSGDTNIWPEYKNRTIFDITNNLSIMILGLRPSDEGTYECVVLKYEKGAFKREHLAEVTLSVKAD

SEQ ID NO: 3021 - protein, 107 aa, Artificial Sequence
  CD80 v533 IgV
VIHVTKEVKEVATLSCGRNVSVEELPQTRIYWQKDKKMVLTMMSGNVNIWPEYKNRTIFDITNNLSIMILGLRPSDEGTYECVVLKYEKPAFKREHLAEVTLSVKAD

SEQ ID NO: 3022 - protein, 107 aa, Artificial Sequence
  CD80 v534 IgV
VIHVTKEVKEVATLSCGFNVSVEELDQTRIYWQKDKKMVLTMMSGETNIWPEYKNRTIFDITNNLSIMILGLRPSDEGTYECVVLKYEKGAFKREHLAEVTLSVKAD

SEQ ID NO: 3023 - protein, 440 aa, Artificial Sequence
  CD80 ECD-Fc
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3024 - protein, 440 aa, Artificial Sequence
  CD80 ECD-Fc
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3025 - protein, 225 aa, Artificial Sequence
  Fc1.1 delta EPKSSD
KTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3026 - protein, 5 aa, Artificial Sequence
  EAAAK linker
EAAAK

SEQ ID NO: 3027 - protein, 15 aa, Artificial Sequence
  (EAAAK)3 linker
EAAAKEAAAKEAAAK

SEQ ID NO: 3028 - protein, 17 aa, Artificial Sequence
  GS(G4S)3 linker
GSGGGGSGGGGSGGGGS

SEQ ID NO: 3029 - protein, 27 aa, Artificial Sequence
  GS(G4S)5 linker
GSGGGGSGGGGSGGGGSGGGGSGGGGS

SEQ ID NO: 3030 - protein, 104 aa, Artificial Sequence
  CD80 WT IgV
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSV

SEQ ID NO: 3031 - protein, 107 aa, Artificial Sequence
  CD80 WT IgV
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKAD

SEQ ID NO: 3032 - protein, 22 aa, Artificial Sequence
  P2A protein
GSGATNFSLLKQAGDVEENPGP

SEQ ID NO: 3033 - protein, 237 aa, Artificial Sequence
  eGFP
SKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 3034 - protein, 237 aa, Artificial Sequence
  Green fluorescent protein
SKGEELFTGVVPILVELDGDVNGHKFSVSGEGEGDATYGKLTLKFICTTGKLPVPWPTLVTTFSYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 3035 - protein, 239 aa, Artificial Sequence
  eGFP
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 3036 - protein, 25 aa, Artificial Sequence
  (EAAAK)5 linker
EAAAKEAAAKEAAAKEAAAKEAAAK

SEQ ID NO: 3037 - protein, 8 aa, Artificial Sequence
  FLAG-tag
DYKDDDDK

SEQ ID NO: 3038 - protein, 6 aa, Artificial Sequence
  6xHis tag
HHHHHH

SEQ ID NO: 3039 - protein, 228 aa, Artificial Sequence
  rabbit Fc
APSTCSKPTCPPPELLGGPSVFIFPPKPKDTLMISRTPEVTCVVVDVSEDDPEVQFTWYINNEQVRTARPPLREQQFNSTIRVVSTLPIAHEDWLRGKEFKCKVHNKALPAPIEKTISKARGQPLEPKVYTMGPPREELSSRSVSLTCMINGFYPSDISVEWEKNGKAEDNYKTTPAVLDSDGSYFLYSKLSVPTSEWQRGDVFTCSVMHEALHNHYTQKSISRSPGK

SEQ ID NO: 3040 - protein, 238 aa, Artificial Sequence
  mouse Fc2b
EPSGPISTINPCPPCKECHKCPAPNLEGGPSVFIFPPNIKDVLMISLTPKVTCVVVDVSEDDPDVQISWFVNNVEVHTAQTQTHREDYNSTIRVVSTLPIQHQDWMSGKEFKCKVNNKDLPSPIERTISKIKGLVRAPQVYILPPPAEQLSRKDVSLTCLVVGFNPGDISVEWTSNGHTEENYKDTAPVLDSDGSYFIYSKLNMKTSKWEKTDSFSCNVRHEGLKNYYLKKTISRSPG

What is claimed is:

1. A method of treating cancer, the method comprising administering to a subject having cancer a therapeutically effective amount of a homodimer of a fusion protein of the formula CD80-linker-Fc, wherein CD80 is a variant CD80 polypeptide comprising the sequence set forth in SEQ ID NO:2276.

2. The method of claim 1, wherein the linker has 1-20 amino acid residues.

3. The method of claim 1, wherein the linker is GSGGGS (SEQ ID NO: 1716).

4. The method of claim 1, wherein the Fc is a variant human IgG1 Fc with reduced effector function.

5. The method of claim 1, wherein the Fc is set forth in SEQ ID NO: 1712, SEQ ID NO: 1713, SEQ ID NO: 1714 or SEQ ID NO: 1715.

6. The method of claim 1, wherein the variant CD80 polypeptide is set forth in SEQ ID NO:2276, the linker is set forth in SEQ ID NO: 1716 and the Fc is set forth in SEQ ID NO:1712.

7. The method of claim 1, wherein the variant CD80 polypeptide is set forth in SEQ ID NO:2276, the linker is set forth in SEQ ID NO: 1716, and the Fc is set forth in SEQ ID NO:1713.

8. The method of claim 1, wherein the variant CD80 polypeptide is set forth in SEQ ID NO:2276, the linker is set forth in SEQ ID NO: 1716, and the Fc is set forth in SEQ ID NO:1714.

9. The method of claim 1, wherein the variant CD80 polypeptide is set forth in SEQ ID NO:2276, the linker is set forth in SEQ ID NO: 1716, and the Fc is set forth in SEQ ID NO:1715.

10. A method of treating cancer, the method comprising administering to a subject having cancer a therapeutically effective amount of a purified CD80-Fc fusion protein homodimer comprising two identical copies of a CD80-Fc fusion protein, wherein the CD80-Fc fusion protein consists of a variant CD80 polypeptide set forth in SEQ ID NO:2276, an Fc domain and a linker, wherein the variant CD80 polypeptide is linked to the Fc domain via the linker.

11. The method of claim 10, wherein the linker has 1-20 amino acid residues.

12. The method of claim 10, wherein the linker is GSGGGGS (SEQ ID NO:1716).

13. The method of claim 10, wherein the Fc domain is a variant human IgG1 Fc domain with reduced effector function compared to wild-type IgG1.

14. The method of claim 10, wherein the Fc domain is a variant IgG1 Fc domain comprising the amino acid substitutions L234A/L235E/G237A, wherein the numbering is according to the EU index of Kabat.

15. The method of claim 10, wherein the Fc domain is a variant IgG1 Fc domain comprising the amino acid substitutions R292C/N297G/V302C, with numbering according to the EU index of Kabat.

16. The method of claim 10, wherein the Fc domain is a variant IgG1 Fc domain comprising the amino acid substitutions E233P/L234V/L235A/G236del/S267K, with numbering according to the EU index of Kabat.

17. The method of claim 12, wherein the Fc domain is a variant IgG1 Fc domain comprising the amino acid substitutions L234A/L235E/G237A.

18. The method of claim 12, wherein the Fc domain is a variant IgG1 Fc domain comprising the amino acid substitutions R292C/N297G/V302C.

19. The method of claim 12, wherein the Fc domain is a variant IgG1 Fc domain comprising the amino acid substitutions E233P/L234V/L235A/G236del/S267K.

* * * * *